United States Patent 8,781,750 (CELL-TYPE-SPECIFIC PATTERNS OF GENE EXPRESSION) - sequence listing, part 55

SEQ ID NO: 38483 - DNA, 222584 bp, Homo sapiens
gtggcactcacggaatctcgggtcttctgacgtgccgggcgggaaggtgagctgtgcgtgcgccttggcggtcgtcttgcgggttctcaagagcccggcgtccgggctccgggatctttggggccattaaaaaagttctgagcgctcatttgggcaataacaccccttttttaaaagtgagaagttcattacattttactgtcagcggtctctcacaaccgaccacccgaaaacccctcctagctacctcgtgacacctcttttcagccaaattgctgcagctcttagcgcataacagacatagaaaagcctgggcaagcctgttttttttttttttgagacggagtctccctctgtcgcccaggctggagtgtagtggagcgatctcggctcactgcaagctccgcctcccggattcacgccattcgcctgcctcagcctcccgagtagctggggctacaggcgcccgtcatcacacccggctaatttacctggattgtttttatacctaaaattatcggaggtgggagaggaagcacccttttcacggtcatggtggccctgtctgaatcaactgcaccttctgtagtgcgcctggcatgtaggaggcgctcagtaaccggaggaaaggaatgaattgggaactctctaggcaactttcctcgaacccctcacgtgacatgtcattaacatattgtgtgtggaatgggaaacgagactagtcttggtgttccaggcactgggctatagtcctttgccacatatctttcccctttgagtaaactgtttcacctcattgggtctcagatttctgaatatagcgggactgtctgatctcaggttctttcagctctagtattttgtttttgtgacttgggaatctgctaacattcaagcactctgttggtccttcatggaaacttgtttaggtgcttcttaagaaattgtcctcctttgtttgccttcttgaatttaaatttttttttccaattttaatttagtatttgttagtgtgcacgtccttttgcccctttgtcctgatttgcagtcgtcctagtttagtggctcttcccttagtaacatcatagcaacctccaaattattggtttggaatatgctcatgtgcctacagtgattaagatagtttgaaaggagggaaaaatcccaagtcactgaagaataggaatattcttatgtgccatcacttcttcagaaagagatgaatgcaatgtgtggcattgcctaagagtggtggaaaataaatgtatattcctctgtagagaccatatttgtacatattatgttcatttaatagttgtagggcatctgttaagtgctaggttctatgatatggaagtgaataaggcacatgcatttccttctttcatggtatttactctcttgacagcagtgcaagcaataaacaagtaaaataaaaataattacagattgtgttataacctactgtatacaggaagtaaataggctccttttaaaatataattgagaaacctattttaggcctgaaatgttaagatctaagggatgcaaggagccagccaattgacaagcagggggaagaatactccaggcagagagtacctgaggtgggaaagaatgttatgacaagagctgaggagctccagcaagtagtaaaggtggttagaaaggtgagcagggctcagtccgacagggccttttcaaaggcctcataaaaatgtggcttgattctaagtgaaggatggggtgggaagtaattcgttgtttctaaagcatattctaaatgatcttgagttgataagtggagaatgagttgcaggggcaagagtggaagtagggagggcagttaagaggcgagtgtggtagttcaagtgagggaggttgaggactaaaggctcactgaagatcgtggagattcaagacattttggaggaggatcttatgtgacttactaatagtctggatatgtgagatgaaagaaaaaaagatttgtaacattttgacttagcaaatggaactttggaggatgataatgtgttcattttcttgattgtagtgatatgtatacatatgtcaaaacatcaaatttgcacactttaaacatgtgcagtgtattgcatgtcaattatatgtcaatgaagctgttaaagaattttctggccaggcgccatggctcacacttgtaatcccagcactttgggaggccgaggcaggcagatcacctgaggccaggagttcgagaccagcctggccaacgtgacgaaccccgtctctatcaaaaatagaaaaattagctgggtgtggtggtacacgcctgtaatcccagttacttaggaggctaaggcaggagaattgcttgaacctgggaggcagagtttgcagtgagctgagatcactccaggctgggtgacagagtgagaccgtctcaaaaaaaaaaaaaaattttttttttcaaggttctggcttagcaaataggtgggtgccacttattgagatgggaaggactggaataggaacaggttttagagcaagaaatggtcatcaagagttccattgtggatgtgttaagttaactgtgagacatctaaatagtttcagagacaggcagtttattatagaaatctgaatgttaaaggcacggtttgggatggagggattaggattgttaataagtaggtgacatcggtatgtaaaaccgtggagatggatgaggttttggttaatctaacaagttttatgacacaaagtaagaggatatgggagtagtggagatggagaaacaggcctcaagaatattggtgtttaaactggagaatacatactcctgggggtgtacctgtcgtaggtagttttaaagacataatttccaagtcttcagcttttgtatatattctttctaaatctgatctgcttgaaattggcttgtgtgttcatgcagattctgctttcccacctttccttttacattgatatttttaacatttgtgaaaagaaatattacaactcactcatctttccatggtatattgctttcggggtgccttataaagaggcagttggaaatatttgatttaggggagccttctttaaggataatggttaagcaaaaacataagcctgccaagggtttgcctgtccctattttaaacacatttctgttaaggctgaagtgtggagatagaattagtatatggtagtctgtgtgggaatgttctgaattcaggcatattgtagaatgtggtggtaggagtgattgtaaggtgatctgggtgggttgtttgatgggaagcttagcaccttcaagtttttactcttggactggttagattctccagagaaaagccttcccattctcctccctagagggcagtattttaggaatttagtggcggaagactagggttctctgcctttagcattcagtctgtatggttcccatgcccacagtctagactgtttcattaataccttctccagagaataaacttacagtctttttcctggggcagttgcctaatagcatgaagtgaggtaggacacttagagatattcctttgtcagtttatacacagccctaacccgtttcacctttaattccaaaggtatcagctactgcttcatatgaattttttttttttagaatactgcagggtaaattggtttggttctcatatgctcccactactggcttgggattttaatttttatgtgttgcaatttgttagtctttttggttttggaattttgaggagtcatatttaggaaaacctccatttccccatctcccctcaatagtgtgaaaagaatcacctttatttcttagttcttttatagttttaatttgtacattttaaactattagttattggggaataaatttttgttaatggtgtggaggtaggaattaaactcctttttttcttctagaggaatagctagttgtctcaataccatttattgaataatccatttttaccctgccctgattttaaatgccacccttgtcatacactaacttcctccattcttattttgttgtggtaagatacacataatataaaaatcacaattacctgttctttcatgatcaatgtctaaaaaatactaatttgagaaaggatgatctttataacctaatatgccaaaaagagagtgaagggaaagatggaagattatcctgtctacttcctgcagactgctttcctgttgttcttttggttccctctgagcactattttgcccaatcattgtgtacttactggactgagttgagctatagctgctgggagaacatattcccttttgtgacaacccctttagtatttccatgagagattatttcctcttctaagcggatgttagaaccagaggcattataacatatgactgggtcagaaacttgtttaaagggttccaaacatgtcagagcctagtgtagtccttatagtttgatggttttatggtaataatatcaggcagccacttataaagtcctttattaattaattttaacagctaattaatcttaacagctaaagtaattttatttactttcccgtattatgtgatgtctctggttatttgtcttaacttttttttacagcttggccttcgaatttggtaaatagtttttagtcacatagtgattaatcattttatttaagtttaatgaacttttattataagggaatgattatcttgttttaagaataacctggctgcttactcagtcaatcagcatcatttatttcattgccaactttgtagagagacctctactttattcattaagaatatatagaataggctgggcacagtgactcatgcctgtaatcccagcactttgggaggccgaggtgggcggatcacctgaggtcgggagttcaagaccagcctgaccaacatggagaaatgctgtctctactaaaaaatacaaaattagccgggtgtgttggcgcatgcctgtaatcccagctactagggaggctgaggcaggagaatcgcttgaacccaggaggcggaggttgtggtgagccaatatcgtgccattgcactccagcttggacagcaagagcgaaactctgtctcaaaaaaaaaaaaaaaaaaagaataggaaaaaaatgtttctgtctttgagatatagtttaataaaggactttgtaaggggctgcctgatattattaccataaaataacacagaatacttaagcacacaattcttaaaaaatgaagcacacagttttcctacaggtgtcaccctgtaggagtttatattttttaaaagatggcccatactcttaagagttttaaaccattggaaggctgttagctactctttttttttcttttttttttttttttgagaccgagtctcactctgttgcccaggctggagtgcaattatgcaatctcagctctctgcaacctccacctcctgggttcaagtgattcttctgcctcagcctccccagtagctgggatttcaggtgcccacgaccacacctggctaatttttctatttttagtagagactgagtttcaccatgttggccaggctggtctcgaactcctgacttcaggtgatccgccctccttggcctcccaaagtgctgggattacaggcatgagccatggtgcccagccagctactcttttaattggcagctacatagcagaggaaactgatgtttgggcttgtgaataaacatcattgtttttgtttttttcctatgaaatgttagttttgaatgacccattacttgtagccaaataaagtgataagaatattcaagtgttgctgattttattttctgtttcttctagatgtcatcattgccaagaagagcgaaagtacaggtccaggatgtggtactgaaagatgaattttcttcattctctgagttgtaagcatactggtttaatatgtgggtaggggaatgatgaatattttaataaggagtaatgcattctgtcactttctaactccttaagtgatgtgggtagaaaaaactttttttattcattcatgcaacaagtatttgttgaactcatgctgtgttccaggttctgtctagtgttgctaataaagtatcgaaaggagagagaaagtaaccaactaaatatgtaacataatacttacactagaatataagctccatgagagcatagagttttatatattgctttagagcaggatttttcaacctctgcactactgacattgtgtgcaagacaattctttgttgtgggggctatcttttttcttgtaggatttttagcagcatccttggcctctacccactggatgccaatagcttcctgctaagttataacaattaaaaatgtctctagacattgctagatatccccagttgagaatctctgctttagagtcatattaggtgctctgaagatatttgttaagtaaatgactggtaatatttatagtaataagtactataaagaaaaataaaacagggcaggggatagagagcatagtgagtggttgcagtcggggggcattttggatagagtagtcagaaagttattgcggaagatgtggcaagagatctagatgagatttgggggtgcagcttgcaaagatcttggggatgggtgttccaaatagagaaagcagcaagtgcaaagaccctgaggcaggaataagtttggtgtgttcagggaacagcaagaagaccagtgtggccagtctagagacatgaggcagagagtagtaagaaatgagattgtaatgagtaggatctggatctaataggcttagatccttctccttagtccctttaacttctcttctcaccaccctctaaatgttggaatccctcaaggcttaattctaagccctccccttcctccaccccccttcccctctcccctccctgttagtagctgatcttgtcttatggctcaatataaaaatctcaattttatacagtatctccaacttgatcttccctggtattagaattttatttgaagtgggttgggaggccactggaaggttttgggttgggatgttacatgacctgggtttatatttgtaaaatattctggtttcttggtggagaatagactatagcgggcaaaactggaagtaggggaaatgagttaaggagattattgtagaagcataggattctagatgtgaaagtgatgagaaatggtctaatttgggatatattttgaaggtagagtggacaggacatggtggtggattggatttggggtatgaaagaatgacagacattttggaaagactggaagaggaacaggtgtgagagtggtggaatcgggaattcagttttggacttggtaagtttgatgtgattgctggacattcaggtgaaagtggatatacaagtcttgagctcaagcggggaaggtcgagttggagatactatataaaattgagattcccagctgggtgtggtggctcacacctgtaatcccagtgctttgggaggccacgtcgggctgatcacttgaggccaggagtccggagtctagcctggccatcatagtgaaacccggctctactaaaaatacaaaaattagccaggcatggtggcacgtgcctataatcccagctacctgggggactgagacgtgagaatcacttgaacccaggaggtggaggttgcagtgaaccgagatcacgtcactgcactccagcctgtgtgacagagggagactctgtctctaaataaataaataaaaataaaatatagattcctgtatcgagaaaatacaagattacctggcaagagagcatagagggctgaggactaagcctcgagggattccagcatttagaggttagggagaagaggagtcaaaggggctaaagagaagctgccaggaagtagtatgaaaaccaagggctggggttcctgtatgtaagggatatgctctaaggggtgagtgccagatgctcctgagagctcaagtgattgggaaggagagttgactagctgccttagaactatatcatgtataacacaacggtatctgtgcttgtgttttgttcataataactaaagggcctttaatcttggtgatattcctttgtgaaatagggttagtcagtaatcctggttgataggtgatgagactaaggagggaagaagtcatcctgctcagtttgatgatagtatgaggagtggaaccctagttttctatttcattggttttctaattatagtttctttcagttccactgctgttatgttattctgattattcctgttttttgtttgattgtttgtttttccttaccaggcttagtggtacctctgaagagaacaccagtagtttgacctatcataattattctcttctagagcataatttagctaagaagtcatccagtcaggtttttgcccccagcaagaacttaacattaaaaaacccagacttccctattcactcatctcagtaaaggaagtctcactaatattgaccttttacattagagtagaaatggaattaactgggttggcaggagcatgatggtcctttaaaagagttcccatggctgctttttctctgctcttgctgtgagtttgattcttcgttgttagaaaagtactatagtcgcacctgatccaatctaatcaggaaagaaatccattctgtgaaaggaaaaaagggttaattaaagcagttggaagggtcttggtgctggcttttaatgtaatttagtgtgtttcctagagccatttctcaatcctttcattgatttgaataacttaatacaatttaaatgaatttgattagtagttgggaacttatttaagtgcttttcactgttaaaattgaaaagctcacattgactatagtttgacatgacccagtaaattacttaaggtaataaatgattttctatgtcttgaatgaatgtgtgtatgtgtttgtcagttaggtgagaagagaatggagagacagagctgtgatttacagcatactgcggtatttttatactggtccgtcatcaactctgttggttcaattcttagcaataactgttcacagcctgtactcaatcactccattttatattaaacacctcctactttatcattttttcaagaatcttgcatctcttttttacctttgacatttgcttttatttttcctggagattattctgttgatttacttctagatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctggtaggtgctacagctggatagagggaactctgtagtgtcttcctgattggtgatgttattttcttattctacagagtaggacaaggcatgtaaatgacaaaaactgccagcaatggcatcccctaccctgggtcttaatttttgggtctgtactgtgtttctttgtctattcccttttccctctcctaggagttggtctgggtgtggtagtgctggtaatgatggtggcattagcaaatagttgagtgcttaccattagccaggcaatgtgctcaacatttcatttaaatgatcttaatctttataacaaccattgaggcaagtgcttttatgctgattttatagatgagaaagctgaagaaagatgttaagtgacttgctcacggtgtacagatagtaagtgatggaactgggtttctaagttaggaacatgattttgtcaacattttgggaacagatatatctctcttgggtgtttttacatcagttgtgttcacaagagagataaatacaaccagagtgctggtttaatatttaatagtttaaaataataatcttaaggacttgaaattcttatggccagcatttcgttctccttggagcctaatctgaatagggaattaagtagtaatcagaaatttacttgatgagcatggactcagaataggatgatgagataaatccattcgtttgagtttattgaatgtccactgtggtctaggcattatgcttgtcacaatcacaattgaatgttttaatagcttgaagctaagacagtggctgacaacaccctttatgattgacactttctttagatatgtcaattcatttgattaggttatcaactcttttaggcctgggagttattttatctttatgtctctgctctgatccattctattttgggcaaaaaatttaatactcagagggctctctaatgttcattattttcaagttcagatggtggtggtggcaggttggcattcaggtggaggtgctctttattgtagttcttaatatttttaatagtgattctggaaaaaatacttgataaaagagaagatagaattttgactaaaatttagtttgggaattgttcatgtttgtgccatctgcatcatttaggtaacggagaacagaccagcttaggggtagggtctttatcttatttacactatacccagtgccgagatgggtgccaagtctcatttcttcacacttgagctgtcacttggattggggggcagtggcagtgcagagtgtagtccctagacacctgtgtgggctgctgtgcggactcttgttaaagaaaaatgcctgacattagcctgctatcattctgtgttctatcctctactcttcagcagaaattggtggcatgtgtagcctgttgagttgtatgagtgaatgagtgttacttttctgtctgctaagtggttgactttgatagcaagttttaatcttggttttctggcatgtgtagacctatcctttactcatttttaaaaattaaactgcttatttctaaatagttgacatgcaatgggaagaaataatagaagaattccatgtactctttatccattttttcccgaatggtagcatcttgcaaatctatagtaagatgtcacaaccgagatacattgataaaatccactgatcttatttagatttctccagttttacttgtattcattcatgtgtatgtatatgtatgtacttggttctgtgcaattttatcgcacatgtaggtttgtgtatctaccatgacagaaaagttccatcaccacaaagatgcctagtgttgcccttttatagccacacccacctccccccatcatctctgacccttgccaacctctaatctcttcaggaatgttatataaatgtattcatatagtatgtaactttgagattggctttttttcccactcaacataatttacttgagattcttccaagttattgtgtgtatcaataatttgttcacttttatttgtgagtaatagtcccaggaaattgctttttatcttctaattctcatatgttctctttgtggtttgatagaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggtatgtgcagcctttttctgtcactttagttgttttgagtgctttctttttgactagcataggggttgtactgtctaagggaagggctgggggttttcaattctctcttcagttttgccagtgatttctggaggctttcctacttgtaactttcttgggtacactgttttgtgttgtagctaatcatcagttcttcagctaagatgtgtggcctctcttggcctttgctatggtgttttagtgaacataaactatatagacagattgtaccaactggttgggcccccacaggttcattgttaagtttttgctttgaacttggactgtattttcctataaaagcagtgtaggtgattaggtcactggctgttcatacatctatttaacccttagtataatgttgtaatgtactacaacaaggcctagcgatttttgaaaggaaattctgtaagaattccaacttgagatgccagaattatatgtcttactacaggggaaatcagatttctcccagtttttttggctggctttggggacagtattggagacccgaagagtagctagtgagcttttgtctgtcccagcacattctgggaccattttagacttaattatggtagtgcctctcagggtaggtgggggtgacttccctccctgttatctgtcccatgtgattctattgtgtactctttcccttgctatgattgtggctgtagagctgagggcctctgctggatcctgattccacttctcaatctgggactgcctgtgtgtcacaaatgtctttgtacccatgctgccttttctattacctcttagtaaaacgtaatttttttttttttttgagacggtgtcttgctctgtcgcccaggctagaatgcagtggtgctcactgtcagctccacctcccgggttcatgccattctcctgcctcagcctcccgagtagctgggactacaggcacctgccaccacgcccggctaatttttcgtatttttagtagagacagggtttcaccgtgttagccaggatggtctcgatctgcctgcctcgtgatctgcccgcctcggcctcccaaagtgctgggattacaggcatgagccaccacgcctggcctgtcactggtaatttttaatcatgatttttcttctctgtggtgcactaaggaatagaatgttgctttacagcttttcctcttaccttgttcctgaatgaatagtccaaggtatcttggaaaaacagagtataattaggctcctttctatgccttctttttctttgttcatttatacctagaaggcagtgttttaaagtgtggtccatggactacctgcatcagattcaccctgaagcctttcttaaagttcttggttccagaccaggcctacagaggcaggtggacatgtaccacttcccttctcttttccttttctaacgctttttaaggttatttccattgttgacatagatccacctctggtagttggcagtgtgcaggaggaagttaagaagttttagactgtgaagtctctggtctttgagacttggtaataagttattcgtagtaaagagctacttattctatgactctgcttcccaccctctgttacagggaaagagatgtagaaaatggccctgccttaaccttttgtctctaggttacaagtatataagctctttataatgagcttaagtagaaaagagtttttcaccaaggacatagggacctttcaaagaacaaaagggacagaatgtggtcaagtctcccaaaggacttgaaccagaaattggaaactgtgaggactcagagaaggtgctgttagttttctctctatctggtgtcttataatcaccaatttctgctgcttctctgtttgagttattattttctcagcagataagattttcttgcttctttacagaggatagaaaatgacagctccctagtttatttgccattagttttattagttacgtagactaaccagttgcttctgtattgcagttccacatttttttttttttttgtgagacagagtctcactctgtcgcccaggctgaagtacagtggcgcgatcttggctcactgcaacctctgcctcccaggttcaagcgattctcctgcctcagcctcctgagtagctggaaccacaggcatgtgccaccacgcctggctaattttttgtatttttagtagagacacggtttcaccatgttagccagaatggtctccgtcttctgacctggtgatccgcccacctctttctcccaaagtgcagggattacaggtgtaagccaccgcactcagcctccagttccaaattttaagaagaaagtctgattggctgaatttgggtcaggtatccatctctggtccagtgcctggggtgctgaggcctcactgtattttagaaatatggctgccagggctgtgtgtgtgtgtgtgtgtgtgtgtgtgtgagggttgtgggtgtgggtgtgtgtgttagggttgtgggtgtgtgtgtgtgtgtgtgtgttagggttgtgggggggtgttctctgagaaaaggagggcatttctgggccagaagatgtctacttcagggttcagctttagaatgtaaatttataaatctaggtgatgattagccactgttgacaaatacttaggtttcttttaccataataccttaaggtgttggtttacagatctttaattgacaagggatcataatacttaccatttatttatagatgacttgttatgagctcggctctgtactaggcactttagatttgtttactacattatcatgatggattagtagatgcaatgggttaaccatcaaaaaatcctttatggataggagtaaaatagacagaaaacagttttgtttgttcagaaaaaccatcttaaagttaaaacttactgagaaattactgagaattgactcaaagtatttgtagaatttagtttctagtttgcatcatttctctaataggtataactgaaggtgatttcagagctttgagagaagaaaatttgttctgcaatccgttaacctagacttttaatgtttggttaggaatgaatatctgggttcactaatgcgttctgtaatgtcactaaaatagcagctaaacaaagccttttggaaaatacattccaagagaaaggcaagattacttgctgaatagaatgaggagggacaagtgtatgatgagcgataggtgcccagctgccagaaggtgagtgacaaaggaaaagtaaagaaagaaaagttttatttgtaagctagtagcagtaatgtcctttgttgtgttgtgggaatagtgacttggaagcaagttgtctcatttaaaggcacaagaactattttatggccttttgccctcttagaaaatattttgaaaattataggcatgctagattttccttttaattccaagcaatttttttttcctcttccttttttgaagtgaatgttgacagctgaatgcctattctctgagaatctgggcactccttgcctgtgaattgggaagtggtttttgggacgctgccacctttgctgagcaatctgatggcaattattaagctcagcattttcctggtgggtttagggaaattgcctgggaaactattacatgtgaattttacatgtttgggttctttttatttaaccagttgcaattatccttccttaattttaacttgaattttacagacaattattgtggtatatgtggatttcctttcctatacttttaaaatttctccgtaaacaggagaaactttgtcagagagaaagtaattttgtcttaaaactgtattcctgcttgtaaacatggttgagaacaggggtagatgttggaaaaagagggaactgacaagaatgagagtcaagtaataccaagccagaaaatcagaaaagtcctgaacatttggataaggatcagactcaacaaaatacctgtaacatgcatattatctgccacaaaatgtatgtccaaattctttgggggaaatcctgaatagttatctagttagcaaggaatggttgtgaaacttaattgtatggaaattattaagtattactagttgaacatgtggaaatgtcatttatatatcctttattttgtgtactattccccatggccttggccacaatgataacttggtcctctgtttttttccgttcaaggtgtatttctcaactctgaaaactacagatttttttcaggaacatcactgtcttgtttggagaggcagaactatatagtcaacacttgatttagttttaggcttgtcaaaaggacaaaattacaagtttagtttaaagatctctgttgggtttatgattctagaatcaagcaacacttcatttcataaaataggataagtgttctaatgaattaagcaggggggttggttttatagataggactaatgaaagcagaaacaacagaaagtggattgctttccttgtaaagtggagagagggagacagaaaaatagaaaaataacagataaaatgaagttacttcagtctttttgtataaggattaaagtagagggaactttattatcatgcctattgaagattgaaactggcctgtttgataaattggctgttatcattctttagatttcttggaaagtcagataacaactttgttttagtttggtgactaaaattttagccagggtgagttcattttgatttttagtctatggaacatagggtctatcggggcctactgcaggagcttcatccaaaacaatggcttcctataatgttttaacagacattatacatgaatgtattttgtttctatttcctgatccggggttggggatcaccaggtcttttgacagaagcaacctactccttttcagccctttctcccaaactgcaaatgtgtgattgcgaccagaaactagtttttgttaaagttattttgcagatatgttttggataccatgaactataagaatttgaagaagtgaccagctacagacaatttttgggaaaattaaactgctccaaaggtggttgttgtccagtttctttcgggagtggtgagtgtaggggagttgagcagccatgtgtaatatcttagtaaagtttgctaaacagggagaaaaggcaaacaaaaccttttttattagctgttttccctttgttgcaagagattgtgtggaattgtgtggaattatgtgcgtgaagaaagccatgggatgacaaaattggggaaagaagtgagacaaaaagtggtcaacatttctgagttgtgtatctcagtgcaattctgtgtataaaggtggaaccacttattaggtttaacctatttgtccaggagaaattaaataagagaaattggtactttttgttaatataatttagttggtagtgtttattatggtctttttaaaaaacaacctttttttgaagtataacatacagaatattgtacataaatgtacagctcagagatgttcaaaagtgtaaccatgcaacaagcttccagaacattaccaacatctcaaaatccccctttatactattttccaattcctccttctgtctcatacaaccactcttctgatttctaacagcactggtttttccttttgcaatctgtaaggaaacttgtgtgtgtagtagaataagtgatacagtgaaataactaggtaagggtaaggagaacagcagaaatcaacagcttttcagaggggaggtggccagtcgctggtttgggagtgatttagaatagaaaattctctcaatttcactcattagagagtcatttaacttagatgttcttttaaaatgcagatgctgcctggatgattaaggctatagtttatttggttgatgccaagatgttttctttttaactgaggaaatagcaatttccttttggaggagtaaatctcaggacactttgggaaaaagcattttcttggaggttttagagagggcattttaagccatcagatctcatgagactcattatcctgagaccagcataggggaaaccgccccccataattcattgcttccacttggttgtgcccttgacacatgaggattatgcctgaggaatcatcttgcttggcatataaattgaatttttgaagaggttatatagcttgtggaattttgggcagtttactttttcggccctcagtttttgcatttataaaatgggaacaataaagtacctttctcatatagtttaaatgagtttatattgactgtgtaagagtgtttggaacgtaatagactctatagaggaattagcctaaaacaacagtcaaaataagtacctctgtcttagaagtacaaaaaattctcgagagtgccttttttcccctttactctcattcctatctgccagttaatttttaaaaaatataaaagtaataaatgtgaatcgcttataagtgaaaactatggtagttctttgccctaccccttcccaactctaagacttgttctctgtttttagctcttttagttgtttctttgttgtttgcctaatttttctcaaacacacgttattaaacccccaccccagagtttctgattgagtggcttttgggtgggacccaagaatttgcatttttaacaagttctcagatgatgcttatgctgctggtttggggaccacacattgtaaaccactgctgtagttcatagatctcatcaactcttgaaaagggggttgactcaacaggtgagaccaaacaatgagtggatccattgttgaatggctttgttaccagtggaaggtatccaagttactgatgtcaaatctgtaagggtctgcagcaacctcagtttttgcctcctcctccaaagaattcgactgaggggcataaagcaagagagaccaaggcaaacttcagagtaggagtggaagtttgtttaaaaggctttagaacaggaaagaaaggaaaggaaagtatgctcggaagagacccaagcaggcactgaggtcaagtgtggtgtttaactttgatcctaggactttataggccagcccctttcccgtgattcttcccttagagtgggctgcccgcatgtgcagtgccctccttatgcttgggaggtgagtacatggtgtgtgtttaggaagttgtacatagcccatctgaggctttctttgcttctttggtggtgtgtccctatgtattagtctgttttcatgctgctgacaaagacatacccaagactgggaagaaaaagtggtttaattggacttacagttccacatggctggggaggcctcagaatcatggtgggaggcaaaaggcacttcttacatggcagcagcaagagaaaatgaggaagaagcaaaagtggaaacccctgataaacccatcagatctggtgagacttattcactatcgcaagaatagcacaggagagactggcccccatgattcaattacctccccctgggtccctcctacaacacgtgggaattctgggagatacaattcaagttgagatttgggtgggcacatagccaaaccatatcacactggaaggtcatactccaccattttgtctctcagtgtgcatgtccgggaagttgcttctccctggtgtctgcattcagttaacactttagtgtaataagtatggaccatcaggaaatggcctcttcctggggctggctgccaatttatcacttttagagaggcaatgtgataattgctgaaccatcacccaacattcctagttggggaggggggctctcctgccatgctcatgcctgtctaactacctgtaacagcttcatattgagtataggatatcaagttcaaactctatagaattcaccatgtagcctcatccacctttccatttctcacctgatcttcacactccttgtacatgtaactgtccaatgggttcattttgcccactgcctacacagagcctatttatcaagacaagagaattgcagtagagaaagagtaattcacacagacccagctgtgtggaaaaccagagttttagtattactcaaatcagtctccctgaaaactcgggaattggagtttttaagataatttggtaggtagggggccagtgagtcaggagtgctgattggttaggtcagagatgaaatcatagggagtcaaagctgtcctcttctgctgagtcagttcctgggtgggggccataagaccagatgaactaggttatcaatctgcatgttgccatctgatccatgtagtgcagggtctgcaaaatatcttaagcactgatcttaggttttacaatgggaatgttatccccaggagcaatttggggatttttaaaatcctgaagcctccagctgcatgactcctgtatttgtccattttcacactgctatgaagacatacctgagactgggtaatttataaaggaaagagggttttttttttttttgagagtttcactcttgttgcccaggctggagtgcagtgttgcaatctcggctcactgcaacctctgcctcccgggttcaagtgattcccctgtctcagtctcctgagtagctgggattacaggcgcataccaccatgcccagctaatttttgtatttttagtagagacggagtttcatcatattgatcaggccagtctcgaactcctgacctcaggttatccgcacgcctcggcctcccaaagtgctgggattacaggcatgagccaccgcacctggccagggaagaggtttaattgacttacagtacagcatggctggggagacctcaggagacttacaatcatggcggaaggggaagcaaacacatccttcttcacatggtggcagggaaaagtgcaagtagaggaaatgccagacacttacaaaaccattatatcttgtaagactcactcattatcacaagaacagcatggggaaaaccacccctttgattcaattacctccaccaggttctgcccttgacacgtggggattatggggattacaaatcaaggtgagatttgggtggggacacagagccaaaccatatcaactcctgaaccataatttctactcttgtggctaatttgttagtcctacaaaggagtctagtccccaggcaggaaggggatttgttttgcaaaaatgctgttattgtcttcgtttcaaagctaaactgtaaactgagttcctcccagagttagttcagcgtacgcctaggaatggacaaggacagcttggaggttaggaacaagatggaattggttaggtcagatctctttcgctgtaataattttctcagttatgatttttgcaaaggcagttttatatatttcagcattactgaacttttagcgatttaaaacatgtgcattggtttctcatcagaggcttttgatgttattctctgttcctggaattcctgcctccctgtttagctgcctggaaataccttcattctctttttgcttttccattgctgcagaattcgatgtttccacctttcctgtggtcttaaaacaatgtatatacacttctgtcagagtatgaaccatactgtatgttgactatttacatgtctgtctgcttttgttagcttgttagctccttgagaagaggcacttgattttttttacatcttgattatcattggcttagtatggttattggcatataatatgagctaaaataaatgttcaactgaatcaatatagaaaacatttggtgatttggagtccccagaatgaagactgcttgtatgtggttttgttagccttaatttcaaggatcaaatttgcataagcagcactgtacactcccataacatacatgatgccatatggatttgttaggacctagtaccatccagtgtctggagtcttagctgtcttaggtttcttttattcaacaataactgagctgttgggtagtgggagcccatggattgctctaacaatcacacagttccaaaatgatgagcattcctgtcgtttccacctgtcatctctgtctttcagaatcttgcctatctttcaagggtcaatcaaaatgctattccttcagcaggcctcccttggttacctcagggagatcttttctttaaaaacatggtgccacttattgcctggcacatgctgttttatttttacttatttggattaatattttatcttcccctctagattgctaacttcttcatgagcagcctcatgaaggcctctcaagagggaagtgtggttgacccttacctgtaggtagctaagagtcattggagcttaagttcaaacaaaagaagaaaataaggggcttgattatatttgtattttagaaatatctgtagtaatgcagatgggatgggtgggaggcatagacaacaataaatacctactatgggttcagatcaaagatgctattagtggaaacagagcttgaggggggagggaacagacattttataagttctgtttgcctccttggtgacagagtagatggatgtgatagagaatatacagtgatgcttaggccattgattagaatgcttttgattacaatgaaagaaaactgtctcaaactagtttaagcaataaaggagatttattgacctatgtaacaggaaatttttggtcagttcactgaaacaatctactattctcttagcaccaccatcctcataacaataaaatggctacaactttgaatttctacctctacaaactgtatttcttcagaggaagttccagcccaaatcttaactttatgctgattgggctaatctctctggccagagcaatgcagcactcaggctgttaattctgaaaacagctggttccttgagcctcatgctgtagagctggagttagggtcaagtgctgtcaagccacatagctgctatataatggagagaggtggccacagtattatgggagataaccacagtatctcctaaggtttctgtggtagatgacatgatgtggactggaacaggaaacaggaaaaggtacaggtttgagagagaaaatataaatgagttgattttgtgagggtcagggaagataacaagcaacaggagtatttctaaagagggaggagcctcatgaaggcctcttaagagcaaagtaactggccttgttctaggaactgagagaaggctattgggctggcatctaatgatctagggaaagactggataagatgaggttggagagaggctgctttcttttgggtcatggtaaggagtttggattccaaatgcaacgggaaatcagtgacaggtcaacatccagtatacattttgaaaataacattcttgttgctttgtgtatactggaatagatgagacagagtggatgcagggagaacaggtaaaagctatttcattagttcaggctagaactagactggggtgtggggcagaagaaatgaagaacagtgacagagtaaggaaatattttgcagttcaagttgactggttcttaagatggattggatttaagagttgaaggagttggaagagttagactcagttttctgggttgaattgccatttgaatagcataatatgggtaaaagtagaggagaaataagtttgagaagaagataactttggaaatgcaaggtttgagatgcccattagatttccaagagaatgtgtcaaaatagttagctaaatgagtctagagctcatgtgaaagagagtcagggatagaaatgtgaaattggctttcttgtcagaattggcattaatccatcagaatgggtgataagatgtagacctcaggatttaatgtgccccgagaatgagatatcctctatagtctctggagtttagccatttatttcatatgtagtcttgaaattcagtctgttatgtatctggacttgattttgataatcagttgattacgataattctttaataaattttccctgttttttaccccagtttctgtcagatcttgggcattcagggttgaaataataataaaacgtactccttttgttctttactttgaaagagctgcttagggtttgggaagctactaaaattggattttattctttctcttttccgggctgacttttgtaaacttttctgtttaactgtacattttgctaaaacctgtagacttaaaaataattaaatatttaaataattaatcatcttttaatattattgtaaatattagtattttaatattataattaacatcaattttaatatgtatttaaaataatttcaaatatcttaatatttataatattttaaaataattaaatatttaaaaatttttaaatattttaatatttataatttaaaataattaaatatttaaaaaattttaaatattttaataattatattttaaaataattaaatatttaaaaaattttaaatattttaatatttataatttaaaataattaaatatttaaaaatttttaaatattttaatatttataatttaaaataattaaatatttaaaataattttaaatattttaatatttataatttaaaataattttaaatattttaatatttataatttaaaataattaaatatttaaaataccaatgattttaaataaataatattttaaaacaaatattttaaaaaataattaattgcctgtttcggtggttcatgccagtaatcccagcactttcggaggctgagacgggaggattgcttgggcccaggtatttgagaccagcttgggcaatgtagtaagacctcatttccactaataaaaaaaaaaaaattagccaggtgtgatggcgtggcttgtagtcccagctatttggaggctgaggctggaggatcagttgagcctgcgagttcaaggttgcattgaatcacagttgtgccactgcactccagcctgggtgaaagagcgagacactgtctcaaaaaaataaaaaaattaaaaagtaattaattagcttgaagatgttgtatttgtgcatgatacaaaattcaaaagatatagaagggtcttccaactctaaccctcacccaaccaattacctttttatttccagatcttgtgaatcatttcatattagttcatatagagctgcctcagattcttaaatgcttgcatggtatttagtatgggcataacatattttccagttcctccattgtaaacttaggtttttgctcacctttactctgctagggacagttcttcaaaaaaaaattattataaataatattttctagaggcatgtatatgttatgataaatttccagtagtagaattgctgctgggccaaagtttgtttatgcattgtaaattttcatagatattgccaaattgctcactagcaatgactaaaaatggctttcctttgctctcatgctgacaaagtgagttaccaactccttgctttgctaccaatatgagagatgaaaagtatatcattgcatcattaaaaagtgccctcattgaacactggaatttgaatgatacagtggtttggattagattttattgaatttgtgaaatggctattttaccattatgattgtcaatggatacatgtattttatatggctttcttttttttaaaaaactatagcaagtagtttctaagtcactggagaacattatttgatactatgttttaaattatacatgatatagatgtttaattttcagcattttaaatcactaagtatctttaatttgcaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacggtaagaaacctaaaaaagaataagcctagtgtaaggggaaaaggccaatgaggaacagtgagaaagtgaatgacggtatatttgacaatttcaacattttgtttccttgaattattgtaatctggatatagtcctctttatttagcgagtgtatggagtccctctgctggtgtgtttatgcatagcttgagcatgtattagcaaaaaggtcatttgcagtaaaagtgtgtgcctcagagtttgactgtcatcttctttcatagaaaaggttgggcataatggcaaaattaggactgccagcaggaaactcagaaagtacattttattctaactcttttaaccactcacataaatctgtccttttaatttcataaagttcctaagtggagagttctttggcagtatagagtttggtaggaaatatgtatatttccttttcccatcttttttttttttcggagacagagtcttgctctgtcgcctgggctgaagtgcagtggtgcaatctcagctcactacaatctctgtatcccaggctcaggcgactctcctgcctcagcctcccgagtagctgagattacaggaatgcgccaccacgccccactaattttgtatttttagtagagacagggttttgccatgttggccaggctgattttgaactcttggccttaagtgatccacccgccttggcctcccaaagtgctgagatgataggcttgagccaccatgcccagcctttttcccatacttttaatggttatggtaatttaacaatagtggattgtaagttttgtatggttacagaatggaaagtacctttttaaaaaaattatgcctctggactcactgctaataactgagaaatatgtgtacaaagactacaagactgaccatattattcgatagggtttattaaaacacttcactgcttatgcatttattgcatgtctcccatgggcactgtgttaatgtgtacattcttcaagtgtacaaaaaagatctgattaaaattggattatcattctactatgaagccattttaaaagtattaagggtaatttttataacaagcttgacaagctttctgttattttgggggaacttgcatctcacttttctacctcttgacgttcttttagtgtcaggagaattaaagtgctaatatgtggaaagttatacttcattgagaggcagaatcaatttgccaatgtaaaaatataaatgactaaatcaaatagtctcagatgcaaatgttccagagccaggctaggataatcaagcatggggaataagaattggagattacaaaccctgtctaagaggggcaacccttgctcgtctccagtagattactgtcatgcagggttgtctgcccagtttgctggttcttcctgtttctgaaaagaagctggtaatttgagtttttacgtaacaaatttctaggccaaacaaaaccactcttgaccacacctagaaggccagcagtttgcaaattctgaagtaagctttctgtttggttgaaggcaaggtaattaagaaagtctgagggttttggatctgaaattggagaaagcctcacaagcaagaaaagcttgcttaaaaaattaaagggtagtctaacaatatttggttgtatgggagacaaataggagctgtatatcaagaatattattattttctttttctttaaaaaacccttctattgcaaaagaattccattctctgggtttctatgaataggggaatacattgaatattagtagaggagtgaatattccttgaagtaagtgggggcattgactggaacttaagagatctttttctataatacagaaatttctttctggtaatgagatatgatctttattttttcttgagctcagcattttctataactagagcattgattttcaatttgttaattgctacccctacatgagaagtaaaaccaatttaataagtcataccacttaaaaaatgaaatagtgaatagaaaatacaagagtacatttatgtggtaaaggcaaatattgtttcatgaaatgtttcaattatgtagcatctatatgtatgtatactgggttgcaacgtaaaacatttttaaattcactgttgaaaagtgaattaaagagtatgattctggatagtaagaaaagttttctgtatttttctctaaagataattctcttcttccttatatgcaggctaataggacaaaaggaattggctttttgttaaaatgacctggtaggctttagcccttgaaaacagtcttgggctaccatgactatagaagacatacaggttgtaatctaagtactgcatattcttctttttaatttatattcttctctttaatttatagtcttctgcctttagttttttttttttaatttacaagtagatttaattttcttttccatcgatcattttgaataaatcatattatcatctctaacttttgcccatcattttagcaataccattattaggcagattctataaataggaggtaatacaataggatgagaagcattaactgtaacaacaggattgtatattcacagtgaaaacctgttgtaaagtgggggaactactgtgcccacccttccttttgtcgttagttgtttagtgatccctgtaaattgattcctggaatcaacttttctacatggaatcctggttctttttagtggggaatggtatttggaaaccaattatgggtgctaggtgtgcccatcctgagcagtgatactccagtagcaatgagcatatctagtacctataccttggtttttaagtatcattcttctgattccagggctggggcagggaaactagaagataagcctgaaatatcatatgccagagaataaggaagtgctcgcagaatgacagatacatgtcaaaaggacacagaagctagcttgaaggggttacttttggccaaatctggaaaaatttgaacattaagataaatgatagcaatggattgtagcactaagtaaaataaaaaaccattaaatctatagtgatataaataaatcagtgaataaattcaaagtttaatgaggaatgggataattatatagtctcaaagtacctctccacaaaatacttataattacaagaggaataaagagtacctgtgtcttggagaaacccacagatactaccttaatcaaatgatcaaagttaattagtaatgagacaaatcaaaatcatttgtcacctaataacgtgtagtaagaacacagtatgacttctatgatatttctgccaaagatgctccatcggtatttaattgtgaggaaacatcagagaaacccaagctgcaggacattctacaaaataactgtccagtagcgttcaaaaacatcaaggccttatcaaggagaagaaaatcaaggagagactaaaatattgttttagcttgaaggagactgtagttgcatgccaactacatgtaacccataattcttaactgaatccactataaaggatattattgggacagttggtaaaacctgaatgagctctgcattagatggtagtaatatattagtgttaattacctgataatgatggttattttgtggttatgtagaagatttgtatttgtaggaaatcacactaaagtgttggagtgcagggatgttaacttattctcaaacagttcagagacaataaagttccttttactttacctgcaacttttctgtaagtttgaggtagctttgaaaagaaagttttgacatacagttttggtatattacaaaagtttctcttttcagggctgttgcaaagaaagttcatagtacaatccagaaaattaagaaggaagggaagatgtctgagtgcttgttaaaagccatgctgaattgtaaaacttttgaagaactagaacacgtggtaaggaatcctttttatcttttaatgtaatacctgaatatattgcaatttgggtcttcttatgattaaagaacaccaagaaataaaaagctaacgtcattagccaccattatttaatgcaacaaaatatttattctttattcaataaatatttatagagtgttttttttgtgctaggcacttgggtttacaaagatgaataaatacatagtctttgtctcaaggaatttccagtcaagtagggaaggacagtagattatacaaacgtgaagcttatcagagagggctgaactagagatccagatgtggatgtcttcagcctgtagttggtacgtgaaaccatgagaatggaagaactcaagaagtgtttgttagcaggtcaggattgaccactggaggttaccaccttttgaagtgtggatggaggatgtgagagcataaggaggtaggaaaaaaatagagaagtatgaggagaatcaggagatgatggtgccctggaacagcagggaagagagttttagatggaggtcatgatcagcagttatgtgtagcagagaagtttggcagaatgaagactgaaaaaaatatatatatttggtaattaggagatcatcatggatttttgtgatatcatttcctgcaaggtatgtgagaagagaagccagatgatggtgggttggagagtgagtggattaagaagtagaagaattggctgggcgcggtggctcaagcctgtaatcccagcactttgggaggccgaggtgggctgatcacgatgtcaggagttcaagaccagcctggccaagatggtgaaaccccgtctctactaaaaatacaaaaattagctgggcgtggtggcgggtgcctgtaatcccagctactcaggtggctgaggcggagaattgcttgaacccgggagtaggaggttgcagtgagctgagatcgtgccactgcactccagcctgggctacagggcaagactccatctcaaaaaaaaaaaaaaaaaaaaaaaaaaagaagtagaagaattgaccggccaggtgcggtggctcacgcctgtaatcccagcactttgggaggccgaggcgggcagatcacgagaccaagagatcaagatcaccctggccaacatggtgaaaccctgtctctactaaaaatgcaaaaaaaaaaaaaaaaaaaaatagctggacgtagtggtgcgctcctgtagtcccagctacctgggagactgaggcaagagaatcacttaaacctgggaggcagagcttgcagtgagccgagatcgcgccactgcactcaggcctgggcgaaagagcgagagtccatctcaaaaaaaagaaaaaaacaaaaaaaacgaagaagtagaattatgtgtagaacacttttaaaggagcttgcttgagttgaggactttgcagtccaagcaatgagtttttaagatgagtgaaaccaagcaactaatttagcatatagaaaaatataaagaataagataaagcacataccatcttcatacagtaaagcattttcaaattagttttaattcatctctgaaggaagaggaaaagattgagaaaaggatttctttagcattctcagcatgtcctctaattttgtaacctagttttaacttttgtttttttaaaacataatcatatgttttctgtctttattttctagtctgctccatataaaactggaagcaaagggactaaagcccagagagcaagacagttgggcttagaaggagcagccagggcactgcttgagaaaccaggggagctcagtctgctatcgtacattaggcctgacgttaaaggtactggctttatttacagagatcaactttgtttctttttttttttttttaatttaaaaacgtatgttaaaaaactgttttgttaagtactgattatacaaaagaatattacagcgtatgtagaataattgaaataaatcctgacatacctattgagtagccattcagcttttctcttttgatgaagtgcctgttctagtcttttgcccgtttttctattgtattgttctttttaaaattattattttaaaataatttttgtcatttatatgtgttgcaaatcttttttcccagtttgtaacttgtcttttcactttctttatggcatcccttgataaataggtattagttgagttttattatagttaatcatcttttaagataatagctgtattttctttttaaagaaattccttcatatcccaagtttataaagattctcctatattgtctgttacagcttttatttctgaaaatttgtttacttgcaaaagtcataaatactctttaaaaatgtcaagagttttgacatccaggaagtgtaaagtgaagctccactctcacacttctactgtagaagtaaagtgtatttttctgaaatttccctccaagtgtatcttcctgttttgtgtgtgtgcatgcacaacagagaataagagagggaagaagtaagggagacatatttctaagaaaaactcaagggaaatgacagttgataaatgtcaagatgcattggttttattgtaaaaatgagtcttagagtgacaactttggttaagagtggctttttctcaggaattcgctgttaggattgagtggggaaattgatgttttggtggtctctactctcaaaaaattatttttttaatattaaaaaattatatagttaacatgtgcaacatgatgttttgatatacatatattaatacatagtgaagtgagtattatagtcaaactattctatacatgataatcaagcaaattaacatattcatcatctcacatagttaccttcttttgtgttaagagcacctaaaatctgtcttagcaaattcacagtatacattacgatattattaactgtagcccccgtgttgtatgttagaactctagtctttttcagcctatgtagctacaactttgtaccctttgacctacgtctttccaccccgcccccacctccagtttcttttgtccttctgtggatcccataggctgggacatgtaaatgtctgtagggggcagtctctgataacaaaatccacagtatgtactaatctgtagaaaattatagcatactatagcctgtttttattttacataacccagcaaatgtgaatttgtgatttaaaaaactgagtgggtgtgtctgtaaaatccaaatatctgttcatacccaaacacacttaatcttaatgtttggagaagggcaataatgaaaaagtaaaaaaggattatgtgaatttagagatgggttgaaatgagtaaaattcaagtttgtttaatttttaatgtgtatttatagttagatttccaaatggttgcaacacttaatattttaataatagctaagactatagctaagcattaaggttaaccacagtgggaaactgtctgtgcccagtcatcatatgttttattaaaatggaatgttgaaactttcagaatgttagatgcacaaaggcttatcgactgcttttatttttatttttctccttgtggttgattttctttccttctacttctcactacctttggtaccaaggtctcttgagttctctcatacactgagttcctactgggtaggtttttgataaccatatctctttggattgtcctacatggtgatgctgctggaatatatgacaatggacacttggtgatacttcttataatgtggatagttcagggtctagcacagttacagtagtactgtactagcagacgtgtgaggacttttgtttgctttactccctctttcttttaccctgatcaaaaatgtagaattattattagtaagtctatataagctaggtactgcttttttttttaagtttgataggaatgttttctctttctctttgtctcctcctcctttatgttacacacaatcatgatcatccttaattttacttgtttttcgaaagaagtttcataattcctatcattcctgaaagaaatatttaagaaaccagatagttcagttttttttttccccagtagaagacacttcttgcttgcttgccacagaccagtaagcatttggtctgaatcataaagctatactgtgccacaaatggactatgtcctgggagatccaaaatactactttcgtgtccaagaggaagttctgtcatacataagaagaggtagcttaagtgcggagaaagtgaaaagaaatgttggcctttcggtttttgtttacaggtgtggaggtttgaagattctgtagctgggaagatttcattgtaaggcaaaggatatgattttctggttctgtgtaccatatttcctcctgatttaactgaggtgctaaacttttggaacatctgttatcttggctgtattaaacccacaagatctattccctttgattgggaaaggagctttttcaaaacacagaagactttccttttaaattatttttctccctggttggactgagaaggggaatgtaatttgaaagagtgtcccaaatgattctgataatttctatctcccattgagaaccactgctctagaagtagctcaaggcatttccctagtggcagttttttaaagttgaatgagtatcagagttatctgggacactccgtgaagtacttcatttccacagtctagccattcatagttttaacaagtacctggtatgattttatttttgggtccttggactacactttacaacatttctctagcgctctagcacaattttaattagattcattaattacataaagtttcaaattatattcccctcttatgatgggggattttcaaaggccctttcttattgcaaagtctataatttcttctgtcctctgcttccattaatggttctccctgtaggttccatctttactattgagttatcaccctgttgttgtcattaaacttcatgtgatgatgctctgggatacttggaactccaggaattagttcttgtgaatggttttcctagatgaagactgagagagctaacagaagagcaaatgtttattgagtgctctatgtgttatagctgttttaagtccattagatatacagtctcccatcttgtaaaggtaatttgttactgaaaattccctcataggaaagttttcttaaaatgtaaatagaattactattagtttcattagccacatttctttctttaaatttctttaaaatgtaattgaccgttgcataatacagagattaggggaacaacccccaccccccccgactccctcttcaaagttgaaaatttaggtataacttttgactttataaaaacttaattgttaatagcctactgttgacctgaagccttactgatgacataaagctgattaacacacattttgtgtgttatatgtgttatatactgtattcttacaataaggtaagctagaaaaaagaaaatgttattaagaaatttgtaaggaaaaaatatatttactgtttattaaatggaagtggattatcataaaggtcttcatcctcatcatcacattgaataggctgacgagaaaaaggaggaggaggaggaggaggagttgtttctgtctcaggaatagcaaaagcagaagtggtggaggaggtggaaggggtgacgagaggcaggcacccttgttccaacttttattgtaattaatccatgtagaagtgcagactggtgcagtggctcacgcctgtaatcccaacactttgggaggctgaggggggcagatcacttgaggtcacgagttcgagaccaggctggccaacacagtgaaagcccgtcactactaaaaatacaaaaattagctgggtgtggtggtgtgtgcctgtaatccctgttacttgggaggctgaggcaggagaatcacttgaacccaggaggcagaggttgcagtgagccaagatcgcaccactgcactccaacctggaagacagtgagactccatctcagaaaaagaaaaagaagtggacctgtacccatgttgtttaaaggtcaactgtaaacataattacttcagtaggtaacatagctatcctaacacaaccaaactagatattttctatttattaattatgccataacaaatatcttcctgtcctctttggcttttgtaccttattacttattaaaactttacttacaggaaaatatacatatgatatgcagtgcttgtgtaattcaggtttagtgcaaaaaacgtttcatgcaaatagaatgataaagacaaaagaaatgaaacaaagcagtgcaaatgatctctctcagtgtaagttgatatcagaaagaccttgatttacaagattcattgctataaattagcaaattagaaatgcttaaagagaacttaatgctcatctgtagacaatttaactgtgaagaggaacaactgcatgaaaactcttgttttgtgcttttgagatttgtgaaattcaaatgggtcgttgaaaatgtgaaaaaatgccccataatccaaaatagaaattgcttctaaaggataattttttaaacaaatggagtagtgtcccttgggttttgactctattaatatatatttcccataacatctttagtatttgtaatcacttcataaaggaggtactgttatgattccatttttataggaaactgaggtacagaggagtcaagtaggttgcccagtgtctcacaactggcaaatggtagaaccaggattcgacaaggcagctggctccagagatgcatttttaccactgggcagtatattatgtattatgtctgtattattgcttttggagacttgtttttgttacaaagggaagctagtatactgctgcaatatctttctgtcttaagactgtcaacttaaggttttattttgactggaattaatttactgtgatttagttatagaatttaaaaccaatcgtatactttttgtttttgttttcctttttacccttctcctaaagggctttcaacgcttcaggatattgaaataggagtgcagcatattttagcagatatgattgctaaagacaaagacacgcttgacttcattcggaacttgtgagtatctcttttatggagttttctgctttatggactcatgctgttaagggtcacacggttagtgctaataccaatgttcattaaaaactttgttttcagacttttttttaaagtagcaaaactctttgttcaaacaacagagcccaaatatataaaacagataaaagtaaagttgttttaattgaattctggacagggagcctggaactctgcctactcaccctccttacactgaggcatctcagtggaggggcctgatgagtttaaaaaccattgccttacacaatatatacgaagagagattcatgtcctttagagtggcattgctttttaaacatgttgattgtgatgtatgcttattttatagtatctcgtttctggtgtttaccagtgattggctttacttgagaatgtgtaatatcagatatgaataaaagtactgacctccaaatgatttttagctgttgaggagagcagcttatctatggcatcacagtcccaatttatcagacattaaagatctttgacctagagccttcttgggcttatggattttatgcatcattaaaaaaacacattaattaaaaaccctatttttgtattattttgttctttttctgctgtgtatcagaagacaggtttctgctagaggtttgttcttcctctctctccctccacatatctagctgtttgagctgtgcagaggagaggaaaggaggagatgacctagttgactactgttgctagaaagaacttttgtattttctcagtggctccagcaggaatgagttgaagcaaaataattgctcaggttttaaaatgtgtttttataagtaattatgccacttaaatttggttcagtattataaattgttattggaagctgtcctgacacatccttttgtttctctttttttaagtttttaattgactgtgactgtcttagtgattagaaaagtctgatatttagatcagagctattggtttgatttctatagatagttttgatcttttgcataattgcagatggtttctgaattcatttaggcattttatgggaagattgagtagatatataaatagatctggaggactatgctagtatgaataggcaaagagtccttttgatggggtagtaatatcaatttcatagctgggcatcattaaaaaaactcacttggtaatggcttaactttttttgctatccttatttctatatattctttactaaagcacaaattaataactgcttgttttttgaacacttgtgtatctgaacaggtgccagaagagacatgtttgtatccagtcatctctggcaaaagtatcctcaaaaaaggtaaatgagaaagatgttgataagtttctgctctaccagcatttttcctgcaacataagaaacattcaccatcatcaggtaaataaagaaactgcatgtgcatgctgatttcgtaataatgataatattttggatttgcctgctactttactaagaatttaaataattttatgtcaactgttttcttttttctttatataaattcttataatattgtcatatccttgccgcttcacaaattgggaagtaatgacccggagaagttaacaagtgacattgagaattattagcagagctgacaatataacattttaggtatcttgactttttggctggtgatctttttgttagactctgcttcccagtatccttatatttgagctcaattctggatctcttccctgtgaaatacaaatatgagatatctgatttagaataaagtgtgagaggtctcatttacttatataaatcagtcattgtatctcagtgttttaatttcatttttcagtttactaattttttttcctaagtgtagtcgtaggctatatctacattgtggaatgtggcttttaaattacatagggcaaaaaggagataaaaaccaaaaatacagtaacactggcgtttatatttacatatatcatgacatttatcagtgttctttatttctttgtatggcttcaagttactatctagtgccctttcattccagtctgaagcacttcctgtaatatttcatgtaaggcaggtctactagtgacaaacttcctagtttttgtttttctggaaaatcttaatttctccttttttaaaaaatttatgtttaattgtggtaagatgaacataacataaaatgtaccatcataaccatttttaagcatacagttcagtaatgggaagcatagtcatattgttgtgccaccaatctccagcaatttttttatcatgcaaaactgaaactctatgcccattaaacatttcattcatttttttatagagagtttttaaaatatagaattcttggttgatggtttttaatttttcccttttaatactaaatataccatccactcttatggtatggcctccatagttttttatgaggaatcagctgttaatcttacgatgccttattcatgacaagtctcttctctcttgctgcattcaggattctctgtctttatcttttgacagtttgattataatgtgtcttgtcatgggtctttctgagtttatcctacttggagtttattgtgattcttagacgtgtagattaatgtttttcatcaaacttaagaaattcttcataataattttaaaaaatatcctttctgcgcctttctctcctctcctgggtctcccattatatgtagagagtatgattgatagtgtctcacaggtctcagcctctgttgctttcttttctttatttttttcttttttctctgactgtatattcccatttgacctatcttcaggcttgttgatttattctttgtattcaaatttgctgttgaacccctggcacatttttatttcagtcattgtacttttcagctccgtaatttctattttgttcttttttataatttctaactcttacttttctatatggttgaaagatcattctcctggctttctttaggtctctgttcatgattttcttgaattcagcatattgaatagagttaatttaaaatctttgttttgtaaggtcaatgtctaagcttcctcatggacagtttttttttttttttttttttttttggtaaagtctggatatgttgtattttataacttggtaactctggaaatcagattctctcccctcccctgtttgttgttgctgcttgttttggggttggtttgctctagtgacttttctaagtatttttgtaaattttgtttgctatgtgtggccactgaggtctcccttgttagcttagtaaccatctagttatttaacagagattcccctaaatgcctggagccaaaaacaaaaacaaaataaaccctaaaagaaaaaaatcccctaaaagaaaaaaacccaaactctcccagactttgcagattggcactttgttggggcactccttcaacacttagtgaggccattaacagctctgccgtagccttttcttcctgtttgcatggagcccaaagttcatctagaggtgaaagcttaaggttccctcagatcttttcagagcatacacctagccctcagcatgcccaggaattttaaaaagccccttttccctcaaatatctcatttccaagtttattttttcacaggttttttgttctctgtgttagttgctcctgtattatcccttacccctcatggctggggctaatatatttgcctttaagtacttttgacaaaggccacctgggaggcttcttctgtcctgagtaagttccaaggcatgtgaaataaagacaagcccttgagtcagttcctcagggacacaccagacatcaaaacacacaaccatagttatttgagaataaggtccatattgctccttctgcaacctgccctaggaacgtgggctgtcatcttcagaggccactgctgagctggagactggggtacgttaaaagtgctctcttatagaaattctgcaacttctttctgtgtttctttcgttgttataaaatttttattagattccatagttgcgaaaaagttaattctgacagtttttgctaccttaccagttacctttgtggagggatggaatttagagttccctactccacaattttcagtgatgtcactcctaacaacgtctttaaaatacagtatcgcacactcctcattctattccagagctggagtgtggcttttaacgttatataaagttttctttattaccttgtttaatgctttttatcctgaagtctgctttggtattaggattgccttgcaacctgtgctttcttaaaggaaattgaccccactctccctactcttgttttaatctcagccctacaattatattaaatgcttgcccttggtccttttgccagagctttccaaagcctttagagtgaatgaaacttattctgtagtctagtatacagttggtaaactttttctgtaaaggtccagtgaacaaatatttaaggttttgtgagccagatggcttttgttgcaactacgcaactgctgtgtaacacaaaatcagtcatagacaatgcataatgaatgagcatggttgtgtttcaacaaaattttattcacaaaaacaggtggcaggctggatttgacccatgggccatagtttgctaacttctgctctagtgaatgtctgaagaaaggtatatgtgtacaatattctctgagttcttacacattcaaaattgttttctatggccttaacacttgaaggatagcttggcatggtataatcacttttgtttgcattttctttacttaagtttcttgaatatgttgctctgctgttggcttcctttgtatgttatatttgagaaatctgatgccagtataattctctgtctcctagaaatgcaaagaggtgggtcctatgttgtgttttatttattttctttattggttttatagttttttgagaaaggaagggggagatttgaaattaggaaactgccagtgtttttcaaacgcggaatttctcaataaataattttaaaatttatttttcttcctatctgcattttactgctataaagagagaataatagaaaaaaaactagtattcctaacctttcatgtaatacttaattttcatcattaagaatgtaattgttttgcatggtggcacatgcctgtagtcccagctactcaggaccctgaggcaggaggattgcttgagtctaggatttctgggctgaagtgcgctatgccgattgggtgttcacattgagtttagtatcaatatggtgaccccacaggaacgggagaccagcaggttgcctaaggaggggtgaactggcccaggtcagaaaaggagcaggtcaaaactgtgctgattagtagtgggattgctcctgtgaatagccactgcattccagcctggtcaacagtgggaccctgcctcttaaaaaaataaaaaagtaattgtttttcatttaagatgacacagatgtgaaaaatttttgttttgttgtaacaagacatgaagagtgtgaattatcccacaagtatttcctgaaaggttattttatgttgggtcctgtttagggtgtagaggtaacatggcccttgcccatttaaagatttgaaatgtttcactattatatctaaaattgtcaattttacttttgtgtacactatatttaccacatcaggtgaagtacatactttcaatattttgaaagaaagtacagtgaaattttacatacgtagttattatagtctactgatacaggtataacataatgaaaagtaatttttaatagtaccagtgactaagtatactaacattccttttgcagaagtagtttttctgtcttattttgtccaccttttatgttgatttaattttattgcaactttggaaaaacattaatgcttttattctgttaaaacctagccttctaatttctgcttgaaaatattttattgggctctgcattttaactagtgtgtgtagcaaatgtggcattctgagttagtgactgaatttaagattatgattgacacaggcttctgggtgtgacagtattcaggcctgggaaagcagagcattttggaaatgtcagttttgaaaaacagcactgctgttttacgaactttttagtttatcatgtacaggccggagtgatgatatgctaggttacaaaaacagcttcccaattcctatagtgctgagacctcatgtcctaaatctgaaccttacttttcagcctttatgtagataaccccagcacagtatcacagaacacagaaatgaatgcaaatgatgaaagacagtgtggtgaaggaaaattactgtggaactctctccaagtactgtgggaatagccgttaatagctgcttagtaaattcttccagctgcatctttttttctttctttttcaaattggtccttagtgtgatcttttctaccacatgaatttgtaactcagtcttcacattctctcatgggactttctgttccttatctttattggtgtgtctttttactgacgtgcaatttcctgtgtcttaactacctatttcctgttcaatgtcaccatctgcagtaattccgctttaacccactactcactttcaatttcagtttctgtcccaagctttattatttctgttaccttattcccttctccaccatgggtcttcctgtgtgtcaggattttttgtaagtttgacgtattacattactaggtatggtgaaaaagagcaaaaaacctccaataatgtattgtgatattatggtatacttatgtaaatcggaattaaataactctcctctatattgttgtactctacttaatttattagagaaaatttcttgtatgaagaacttctgtttactaagctggcacagcctatagcaaatacggaagtctctgctgagctcaaactgaagtttattttgtattcacaatttatttctttatagatagttctgtgcagtattattgaatatattgttttatgtaagcttacttttttttttttttcttagacagtatcttgctctttcacccaggctggagtgcagtggcagaatcccacctcactgcaagtttcgccttgcgggctgaaggcattctcccacttcagcctcctgaggagctgggactatgggcatgcacaagcacacctggctgatttttgtattttttgagagttggggtttcgccatgttgcccaggctcatcttgaactcctgagctcaaccagtcctcctgctttggcctctcaaagtgctgggattatgagcatgagcccccatacccagccgaaacatttatttctaagtgattgttctatttctgctgatgtttactttagaaatttctcaagtatataagaaaagaaaaaagtcccctatataatttttttaaaactctgacaatttgtttgatatttaaaattttactcaatatttttaaaatttaaattaaagttacaaaaaaatacgcgttttatcttttgacattcttttcaacatgaagcacaaattgagaaattttcgtggtagaattattttgtggtaatattaagttgaattattctaagcttgtttcaccacagataggaagtctaagtttttgttagagatcctcatggaaatgtgctaaaattgttaaaatatcagtttgtgtcctgtaaagggagaacttagtttattaaaatcccattcattaagagtaattggaagaaagccattaagaattagtgagaaatctgaatatatgttgaagtgatgttgtttaatttttaatatataatatacataaatatatagttacagactagcagatatttaagggaggctgttaacttgattaaattatttggttaatttgtgttactatttatcatcttaataattggtattaaagagtgctttaagaaaagagtgttttaattttctaataggtttattgaagtaaaattcatattgcatttaatgcaaccattagaactttgtaagttcaatggtttttcgtaaattcactcagttgtgtcaccattaccacaagcaattttaggacatttttctcccaaatatttccttgcatcaagctctaggcagccaactttctatctctatagatttgtctgttctggtcatttcatataaaggaatcatacaatatgcagacttttgccgctggtttctttcacttagcataatggtttcagagtttgtctgttatggtatgtattagtatgcctttcctttttattgctacgtaatattacattatatggattctccacattttacttatccattcatcagtcagtgaatagtttggttgtttctactttttggatattatgaataatgctatgaacattcgtgtctaagtttttgtgtggacatatgtttttatttctcttggatatatacctaggagtataattgctgtgttatatggtagctttacatttaaccttttgaggaactgccatattttccagagtggctatgccatttttacattctcaccagcggtttgtgaaggttccgatttctctacatccctcccaacatttattgtccatctttttgtgttttgatttgcatttctctaatgatgctgagcatctattcatgtacttatcagtcatttgtatataatttttgaacaaatacctcttcagatcttttgtacattttaaattgggttgtggccaggcgcgatggctcacgcctataatccaagcactttgggaggttgaggcaggcggatcgcctgaggtcaggagttcgagaccagcctggccaacatggtgaaaccccatctcttaagaaaataaataaatgaataaattgggttttgtctccttattgttgagctgtaggagttttaaatatattctagatacccttatgtgacatatgatttgcaaaaatttttgtcccatgccgtgcattttcttttcactttcttgatactattctttgaggcacaaaaactaaaatttgttgaagttcaatctagttttttgttattgattacacttttggtgttatatctaagaaggctttatgacttgaggtcataaaaattttctccttttttaatggaaattttatagttttagttcttgtattaaggtctaagatcaattttgagttaatttttatgtatagcgtgaagtaggggtccgtccacttttgttcttttgcatgtggtgagttctagttattcatgatttattgaaaagattggattttcttcattgaattatcttggtacccttgttgaaaatcagttgacactatatgtataagtttatttctggactccgattctattccattgtatgtctatccttatgccagtccccactgtcttgataactgtggctttgtagtcagttttgaaattgggaagtgggaatcttccaagtttattttgatttttaaaaattgacttggctattctcagtcctttgaattactatatgtgttttaaaattagttcaccagtttccacaaaacatgccaattgggatttgatagggatttcactgaatttgtaaatcaacttggggagtgttgccatcttagcaatattaggccctctgatccctgaacatgggatgttcatgggtatttatttagatcttctttaatttctttcaacaatgttttgtagttttcatagtacagttgttccttggtatatacaggagattgattccaggatccctgcatatacccaaatctatgtatatgcaagtcccagagttggccctgcagaacccatgtatatgaaaaatcagctctccttatgcgtgggtttcagatcctgcaattactgtattttcaatccctgtttggttgaaaaaaatccacgtgtaagtcaacacatgcagtttaaacctgtattgttcaaaggtcaaccgtgtaagttgtgaactttttttgttaaatttattcctaagtattttattccttttggtggtatcataaatggaattaaaaaaaattattttcagaatgtttattgctagtatgtataaattaattttatttgttgagcttgtgttctgcaactttgctgaactctttattagttctaatagttttgtagtggattgcttagaattttctatatataagatcatgttagctgcaaatagagaaagttttacatcttcctttccaatatagatggcctcccttcttttccctggctagaaccttcagtacaatgttgtgagagtggacacgcttgtcttgttcctggtctttgaccagtaaatatgatgttagctgtgagatttctgtgcacaagccctttctcatattaaagaactttccttatatttccaagttttttgagtgttttttatcatgaagggctacctgattttgtcagatgtttttccacatctattgagatgatcataggatttttgttatttattctattgatataatgtgttaggttaattgattttttagatgttaaatcaaccgggcattcctggaattgattctagttgatcttggtgtataatccttcttatatatttctggatgtggtttgctattactttattgaggatttttacatctatattcataagagatattggtttgtagttttcttgtgaagtcttgtctggtttttgtatcagagtaatactggcctcatagaaatatatgtgaagtttttccttctctaatatcttttggaaagtttgtgaagaatggatattgattctttttagaatgtttggtagaattcaatggtggtgccatctgggcctggacatttatttgtgggaaattttcaaattactaattcagtgtccatactttttataggtgtgttcagattttctgtttctttttggtttgtttttggtagtttgtatcttttaggaatttgtccattttatcttagttatctaatttgtcatacagttgctcatggtatctcttataatcttttttatttctataaggtccttagtagtggcctctcttttgttcctgatcttggtgtttgagtgtttcctgttgtttttcttgattagtctagcgaaaggtctgttaattttgttgatatcttcaaagaaccaacttatggttttgttgatatttattgcttttctattctctattttatttttaccctattatttattattttcttctgcttgttttggttttgtttatactttaaggagtgtttttaatgtgttttaagacagtcgttcttttaatattttaattaagagcatggacagattgatctgaagtttaaattctttttttgctacttgctagctttgtgatttgcaacaagttagtttcagaaaaattattatataaagtgaagataatacacacattactggtgactctaaggattacttgagataatatatttaaagtgcttagataggctctacaattagtaatgctcaatggatggtaacaatttgtagctactaaatattgcacctaggattttacatgtttgtatttatcttagcacaggttatcttttcaaattataaaaagtatacccttccaactccagataatcaaaaattttcaattagtagaatctgaaatgagatttttagatcatcaaagtctcttcttgtaaatgtgttagataggctttgtatctgcattttattttctaagagcatgttagggttttccttatgtgggaggtatgttacttgaaaaaagtgtaagtaaatgattattttaaaatgtattcttgtttaataaacgagtaaaaaattcatatagctgtcagctacatagtcgcctgatttgtttcatatattttgtggattattagtctttgccttatgtttgcactcagattctggcaattaaccgtggagaaaatttgaaggtactgacggttaaggtcaatatttctgatggagtgaaggatgaattctgtaggtggtgcatccaaaacaggtctgtttacagatatttacagaattttctttgtttcttttctaaaatatgataccgatatctatatgtactgatatgtaaagatgtctattacgtgaacatttttaaaaagccagtgacaggccgggcgcggtggctcacgcctgtaatcccagcactttcggaggctgaggggggtggatcgcgaggtcaggagttcaatatgagcctggccaagatggtgaaaccctgtctctactgaaaatacaaaaacaaaaaattagctgggcatggtggtgcacacctgtaatccccgctacttaggaggctgaggcagagaattgcttgaacccaagaggctgaggttgcagtgagccgagatcacaccactgcactccagcctgggcgacagagcaagactccatctcaagaaaacaaacaaacaaacaaaaaacccaccaataacagacaaggtatgtagtgtcctttttgaattaaaaaaaataataaaataagtatgtgtgtcatgcatatttaaacagagaatatccaggagggtgtgtgaggaatttttgatagtgattatctctgtggagaagaactgttttacttcattacttttctgtactatttgaaacttttgtaagatcatcttttcccttgcaaaaataaactaacaaaaatatgctctatgtatcatatctgaagtgtttagctctttaaggatgatggaaacaaaaattaacttattggatattacaatataaataagcattctgtatgtggggataaatgttgcatgttaaggatgattgaaagaaacattaaatttattagatattttaaggaaatgtctaagcttatgtaattttttattaccctttttatttgttaagggagccttttaaaatagcaccatgtttgtataatactttttacttttagttttaatttttcagagtgtaattgatcctcacaaaaatctatttagttggtagagcagattttgtagccaccacttagccagtgagaaaactgatacaaagaggtaagtaaagtggcttcctagcagctaggagatgtaaattttgataaagttcatcaccagctagttctgtgtaactttaggataaagagattgctaggaatgatacttaaaaagttagatgacttgttctttgaaaataagtatcatggattttggaaatcagttatctcattcaacacaactgttttgttaattcattaaaagcaatgaaggatcaacttgcttaacaaccaaatactactaactaagcaaccattaagtaaaacaacagtctaaatgttaatcaataggtaaattgcttaagccaattatgttatatccatatggtggaattctgtgcagccattttgaaaaagtggaaatagagctgaagttgaaatatgaacatgtcttactaagttaaaaagacaatttacaattagcatttatttatagtatgatttcactagtggcaaataagtgtctttatattactgtgtatatttttctatatagtttcttttctttttctttttttgagagacagggtctcactctgttgcctaggctggagcacacaggtgctatcatagctcactacagcctcaatctcccagactccagtgattctcccactttagtctcctgtgtagctgggaccataggtgcataccgctggctaaacttttttttttttttttatttaagagatgaggtcttgccatgttgcccaggctggtcttgaactcctgggctcaagcggtccttctatctgagcctcccaaaatgctggcgtgacaggcgtgacccaccatgcctggctagttgtcattttttatgaatgcttatttcctttataaataagcaaataaattccaatgaaaggaaagaggaaatgtatgcctaaaagaaatgctagatttaaaaaattaggaaattagataatttaagatatgacaaaactctaagatagtttcatagaggaaactcctaagaagtagatatatttgagtttgaattccagttatattactttctacctctgcacctatgggcatgctacttaatttctttctcagttttgtctatccttaaaatggtaatactttacttgtagatttgagagaattaaatgataatctacgtaactgtatagcacaatgtctggtgaagaacaggcctttgatggtatctgttattacaaagtagtgggattattgtgctaattctttttagaaatgttttagtaaatcacaaagacaatttctggcttatttttctgtaaatattcataatactcagtatcagagtcagtcctcagtagttaaagaaaaaatatgcttttaacctatttattatctttagactaagtaaatgtcaaggaatttttttacagtgatttatttttccatggcttatttatattttatttagttctccaattgaaaaatttgtaatattatttagcctacaatgtaacatgttacatcattatggcatagtaatataattttcagtcaggtttggaagtttttctttttcttttttttcttttcttttttgagacagggtctcactctgtctgtcactcatgctggagtgcagtggcatgatcttggctcactgcagccttgacttcccagtttcaagctgtcctctcacctgagcctcctgagtagctgggactacaggtgcgcaccaccacacccagctaaatttttctttcttgtagagacaggggttttgccatatttcccaggctgttctcaaactcctgaactcaagtgatccaccaacttccgcctcccaaagtactgggatgaaccaccccaggcatgaaccaccatgcccggcctgaaactttttcttcatttagataattccaagagctgaaacacttttctaggacctaaaaaattattctcaaaagaacttttttttttcctttaagcacatgtgaatgactagaaatgcttacttgatgaatcttctagttcctttttttactctctttttccctatttcttcaccctcttctgtatgtacttatccattcaagttatgtgctagattttggagattcccctgtaaattagacagatatactgcttatccatgatgacagcgtagtttaatgagaacaacactgggaaaatcattacgagtatgttgagattatgaaggaaaagtgtagtaagaagaagaaaagtgcttgtaacagagccctgagtagtgtggacttgacagctaggtaggttggagatagaaggagaaggaagagaagtgacatggaatgaagattgagatgttgacacaggttagatcatacatagctttcaggtatgctaaagatttttttcttttaaggatggtgggaagccaataaggattttaaatacaggagtgtgatgatcagattgcattttaagatcactcaggccacagtgtagataattatttggaaggaatcaagagtagatatggcacaagagattatggtagcttagactagggtggtagcaatagggaataagtagatagatttgggcaatatttaggaggtagacaggggcaggacaaggtatctgattaaatggtgggtggattggttagggagaggtgaagtgaagcatgaaatttgtgtggcggctgggcgtggtggctcacgcctgtaatcccagcactttgggagaccaaggtgagaggatcacctgagatcaggagttcaagactttgagaccaacctgaccaacatggcgaaaccctgtctctacacaaaatacaaaaattaaccaggcatggtggtgcatgcgtgtaaccccagctacttgggaggctgaggcaggagaattgcttgaacccaggaggtggaggttgcagtgagccgagattgcgccattgcactccagcctgggtgacaagagtgaaactccatctcaaaaaaaaaaaaaaaaaaaaaaataattgtgtggcttgaacaataaggtagatgatatagttactatcacactataaatatattaagaactatgtaatagggcaaatagtgatttaaatggcagtcttgtcattacataagttaattagcataacaaggaataatttaaagctaatgtattagtattaaaactaatatttaggtccagattcagcaaatgaacaattcctcatttggaattgtatgttactagtacaagataagtatgaagaggatttctaagctttttagatgctgaaatagttgctgtgtttgtgagaacctcagtaatttaagtttctgcatttgctctctaaataaaaacgtatctaaggaaattttttttaaaaaattaagaaaacttctttttagagacattatctcactatgttgctcaggctggtctcaaactcctggatttaaacaatccttctgcctcagccttcaaattagctgggactgcaggcatgcaccaccacacctggcttcagaacttgtcttttgagtttgcagatttttgtgtctttgacttgataagttaatttttattctccctaaaattgtgctgctgtttttcatgtagtaggtttaagggaaactgtctctactttaaatgtggaaaaaagaaagcccagtggagagagcctgtctttatcttatatatatgaagttgggagagcatatttctttgccaaagtggagaatatttctttggaggagtttgtgatccctcacctcagttttgtgcttcattgtatgcaacatacatagcatgtgttttgcaatgtatatttggtttaagtgagtcctccttagttttattcagatgtatttaactgttgaattagaggaagaatcaagttttgagatgacttcctgtaaggcaaacccatcatattttctttaagtttaaagatttaagcaacagggtttgtgaatttactatactatttcaggttccttagtatgctaagtgccttcaataaatcccaggaagccggtgaagggcaggaattgttttggtgtaaggagcaaaaaggagtttctataatgtaggaaatgaatgtagctgttctctttcagggctgggtctagtggtctaaagttcaactgaatgggcatgattgaggcatcctcaagtattaaatagacccatagctctctgttccaggaaggggaggagagcagtccaagccaagggaggatcttgagacttgaagaagactactgggggtttgagagggtatgggtaggtgatatttaagatttctggctttttcctgcaagcagtggcttaaagggcaacaccttaggagacaaatcagatacatacattaaaacaaatccctctgttagggtcttcctacctctaaggactatctgtctagcatactgttgcatgattcaggactatgttctctctcctacctcgtcaggctccatagctttgtgtataagaccctttatgatccagccactgccacattttctaccctcatctttcctcctgttgatcttgccactttatttcctagaagcgctaaccttatagttacttcaatttaccgtgctttttcatgcctctaagcttttacatatgctataatttcttcccagaatgcccttattcttttgtcttgcttggcaaactacaattcattaaaaaaacctatctcagatgtttcttttgggaagtctttcttgacattggattccccatattaataataacagcagcagcagcagcagcaaaaacttacatagaatgtattaggcaccattataagtcccttgcttatgttaactcacaacaattcaatgaagtagactattattactcccattttactgatgaagaaatagtagcacagatatacttaagtaaatccaccatgaacatagagcaaggccagacatggtgggtcacgcctataatcccagcactttgggaggccaaagcaggtagatcacttgaggtcagcagttcgagactggcctgcacaaagtggtgaaaacctgtctctgctaaaaatacaaaaattagctgggcgggatggcgcacgtctgtagtcccagctactcgggaggctgaggcaggagaatggcttgaacctgggaggtggaggttgcaatgagccaagattgtgcctctgcactccagcctgggtgacagaatgagatgagactctgtctcaaaaaaaaaaaaaaaaaaaaaaaaaaagtaatagagcatagagcagaacagatcatacttttaactagtatattatactgctgtttgctgtcacttctgcttttgagctcttcatatctttaacatttatttctgtttttacatttattgtgccatacatttgtttagatatttgtttcattgaaaaaaggtgtgtttgttgaattcatgccttttttcaatggagtagagaaatcctactcctctgtatccctaattccttcaggcaaatgttacagtagggagcagcagggatttaggtggaaggaaggatgtatatcctgcctaaaagcacttccactaaaatttaaaaactgtatgacactttctatggaagagattcagttagttgctattatgtaatctttggaataaaacattgtaagtgcttaaatgtttgttcagtgaaatgtagttcatttcctagcctaagataagtaaaggggatgagagtacccttaaggtaatattaattaatattttgttaatggttttcattcaagagggcaagggcagagatgctgtagatggatgaaaacacagaatggatagtatcataggaccaacaggtttatatgcccactgtgccgtaacagactaatacaccaagacagcagggtttgtagcagagaaaagagtttaatgggcctggcgaggtagctcacgcctgcaatcccagcactttgggaggctgacatgggcagatcacgaggtcaggagatcgagaccatcctggctaatacagtgaaaccccatctctactaaaaatacaaaaacaaaaaattagccgggtatggtggcgcctgtagtcccagctactcaggaggctgaggcaggagaatggcatgaacccaggaggtggaggttgcagtgggccgggatcgcgccactgcactccagcctgggcgacagagcaggactccgtctcaaaaaaaaaaaaaaaaaaaagggtttaatgattgcagggcactgagtgaagagatgggaggaggccttgaaatccatttttccaaaaaattctgggctgggttttttttgtttgttttgtttttgtttttaagaaagggtctctgttgcttagctgtagtgcagtggtgcatcatggcttactacagcttcaacctcctgggctcaagtgatcctcctgcttcagccttctaagtagcagggactacaggcacacaccaacacatccagctaaatttttattttttgtagagacaaggtctggctatgttgcccagactagtcttgaactccaagtgatcctcccactttggcctctggaaggccatactctgggattacagatgtgagttactgtgcccagcctgggctaggatttttaaggggatcgtggagggaaaggagctggaaatttgtggtctttgattggttggggtaagggggataaaatcatcagcatatggaaactgtactgtttggtgagtcagcttcttggtgggagtctttcatagtagctgatgtcagtagtttcattggtacacaggacctgaaagagtattcaaatggaaaacttaacatttcataatgttcaggttgttacctatagagcagttaaggggagctataatctagtaacagggtctgtgtgattctaggacagtaggcaccaaacaactatgaggaagcaggtcagagagtgagctgacctcatgattaatgctgaatgtgctgccagcttggtttattttcatttctagccctcctttctttcctgattaattttataaggtttatagggaccgtttcagtgaggctacatttgtccttttagcttgtgattttctcttctattctttccccagtgttcattaacaattggttctgtggcatttatagtcctcattacatatgcagatgttgcctggtagagcattgtggcctgagcaatagagtaagttctcagaaatggcaagaggcaagggttgaaacagagtttctgctttgctcagtctactttaactctcagaaagagataaagaaagggggaaaaaaggatacagtggctgtcttaacttggactaacataacaaaataccacagactatgtggcttcaaccggagtaatttattttctcatagttctggaggctgagaagtccaagatcaaaatgccagctgattcattttctggtgagggctgccctccttggcttgtagacagctgcattcttgctgtgtcctcacatggttgagaaagagagagaaagagcaagccctctgttatctcttcttatcagggcactgattccatcctgagagccccacccttatgacttcatctaaacctgattatcccccaaaagccccatcttcaaggtatggatatggggagggacacaattcagtctgtagcagtggtgtaataattttttggtgactttcttgtatcttaagattttggccattattaataatgctttggagaccctttactgaagaggaaattttttccttgttttatatctgaccatagatagttactaggatttttaaaataaaaactccagatgtcatagtaataattttcagataccacagcctttcctcacagattatgttactttggcttcaataaaggttttccccgcttctgtattccatctcccttctttttgggagcctttttatggccttatttattgttgcatcagttttagtgtgggcttttctgttttgcaggtggagaccacgtagctttgcaaggccagagttaatgaagatcttatataattcactgaatgattcctttaaacgccttatttatcctcttctctgtagagaattcaggtatatatcttgtcttgtttaattttgtgtactgattattgttatatgatactagtaccattacagtgtgtagctaatgtttgttgattgattaaccaatcgaaagaatttagtcagcatcacaaagtgttaaagttaaggcttgatttcaatctgtagatgcattcacatgcatagatcataaaaatagttcttaattatgatatgtttttcaaatcttgaccacttaatgtgtaccccttgaaatcctgcaatactagtcttgcagctggaggcagtttttagaggtaagagagccaaagaaagcataaggaaatcagtagggtacatgatgaatcaattactttgtttttaactccaaatgggagttatttggatgaaaaattatcagcaatgataaatattaggagattattaaaatggcaatgtgaacggactaatagaaggactaagtaatatagatgaaaactgcaaaagaggtgaggtgcagaattgttttcaggacagaagatggaaagaaaagaaatgtagggaggcaaaactcctctctcttgcttctctgtaacccttgtttttgcacccaatctttagaaactagacattccctaattcattccttccaaaatattatagattatcttcattctcatttctttgtaggtttcagcaagggctacttgaaaactgtagttttgtagccatctcttcaacctctctagaatttttagcagcctatgtagggcttgtttctcttttgctggacttgaccattgaattaagatgggttcagagcagggagtgagcaggtactattaaaaaagacacatagtcctgttgtccaatttctttttaccaaagtcatttaatctcttgttacatccattttagcctagatgtagcctaaaaatattgttccttttagaattgtatttcacttcaagctgtctaacatcgcttgcttttgagagctagggcatacactttaaaaattaggaatttggttcttcctgaaggaaaaaattatgttatttaaaatttcaatttctttttgtatgtttttctttttattgttttctcatgttgcttatgtctagtggcacttttgacattttttgcatatatttttgatttgagtagcttcactgcatgtggaataatttcatcaaggtttaatgtaaacagtttgatgtgggatcatttaatgtataaactgtttctgaattccattagcagtagataagcaagagtactttctctttctttttctaaaatgcccatggttaaaataatataacttatttcagtttataagttagtttgcaggtattatctacagatacgcctcctgataggaatacttaacctgaatagcagttaaagaggaggacactcccacttggtttgttttttagaccattttattttgcagtcacttaatttggttgactgtatactatgcatagcctacgtctgcatatcttattcccgtgactgtcatgatcattcatccatgtgtcatttttcacatctatctctgtcatcagttctacattgtcagttacaaagtgctatctattttgccatcttttattataacttgaatttttcctcccctttatctccgtggtgactgtcttaattcaggacatcatcattttttgtctggattactgaactagcgtcatagatgatcttggtcttctgtcttgtcttttccaatgcatattacaaatcgccctttcaaaattctcatctcacaatttcatgcttgtatacttctttcagctgatcttgtttgtctccaggatagaatccaagctcttgagaagaacatgcatgaccctttgtgatctgtttttttcttgcctctacttctgtctcgctgtttctttttactttagcatacgaaattacttgctgtttctatgatgagccatgagcctttacatatgctgtttccattgtccgggatattttctccctgcccactgtgcctacttttgtttgcatcccatgtgacattcaaatgtgcgtacactctctgtctttctcacatatacacatatttataaatatgggttttatatacagtagagagcagatagagaggtaatgtaggtatgataaacttacaagacttgcttcagaattgcttgtggtatcatattactgtgattagtgaaaatagactcaatataatttttgtatatttttctcttaagttatattgttataataaattatcctttgagaaataattgtacaaaatgaattctgctccttttctggaaagaaaatttgggtgaatgaaaaactttttcttttcttctatttctaaagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtaagttgtcttgcaattttccatgtaaaagttgtttggttggttataagtttcacttcatacatttcatgaggatttggaaataatgttaattttaaaggcttaaaaagtggttttctcacatacaggggtgttgggaaccagataatcaaacttcatttttctctcatttgttgatcaaactcctcaatatacaactatcatttatatgcttcctatatctcagtagagatattgaggattaattaggctcggacttgaactctattaattccccatcagattctattattgtgatgcatttatatatgatgcattttaattctgcttatattttaaataccaaaagacatttttattgttttgctcaattttttttcctgtttacttacatttacactgatattcttcatttcttttgcatttccgtgcttccatttgagatcattttctttctgcctgaagaactctatgctattacttttaatgagtcacattgtcttagttttagtttgtctgaaaacatctctgttttgccttcatttttgaagaatattttttgcttggtgtagaattcaagattggcagttactttcagtactttaaagatgtcattcttttttttttttttggctactgtaatttttgttgagaagtcagccaaactgtggttatttgttattgttcctttgaaggtaatatgtccttttcctctggctgctaagattttctctttgtgtttctcagttttcttatgatgtgcttcagtgggtgtgtatgtatgggttttcttgtcttttcttttctgcatgaattccacttagggtttgtggagcttctagcatctctttctggaactccaattacatacatattatacctttcagtttcttctctcctttttgtttattttctgttgatcatctaagttaattaatcctctatcctgctatgtctaatttgttactaaaaccatctactgggttcaagtggttggtttttcagttttagaatttccatttgatactttgaaaaatagggttatagctccctatgaacttctttatttctaatgtttttgatcttttaacttcttgttttattttctattagcctttactattttaattttttaagtttagattttcatttctgaaataattttttctttcatctcgaattcattcccagtttatctcatctaatttctgagattttctaattttgacttatgttattcttttatttatttaacttttactgagtcagggtcttgctcttttacccaggctggagcacagtggcgtgatctcagctcactgcagcctctgcttcctgtgctcaaactatcctcccacctcagcctcccgagtagctgggaccataggcacgcaccaccatgcctgccttttttttttttttttttttgtatttttagtagagacggagtttcgtcatgttgcccaggctggtcttgaaatcctgagctcaagctatgtgcctgccttggccttccaaagtgctgggattaccagcatgagccagaattaacgttactcttattttctgtaatgtttttttttaagaagcttgttctcatacattaggcacatctttctgtaaggacattatattagtcttttaaaaatttttttgcttaaaaaaataatcattctatatagaatttgactatcatgcatttcttttgtttagttttacatacgttagtttgaacttttagtagaagctgggtcaggcaagttgttctcactgtatatctctagaacttgctcttctgttttttccaaatcattaaaaaaaaaaactctgtgtggattgagagatagtttatagtttctggaatctgcttctctgttgctttcctttattttatctgggctttctttttcctttgctgttgctatctttactttgctcagtttgaatgtgattaccaattgtttctcctcagtgtggaatttttgtctttaaaggtatcttttactagttagtttcaagagttcatagggatcagtgttttccaatcctttcagaagtactggatcccctttgtgctgaatctctctcagtttcagctcctgttctcaaactgactgttgagatttccagggaagtagcctttgacatttttgggattctcctgttctcagttccatcatatattccactgtttctttctgcttccttccatgcagatgctgatgcataggtgtcttgtcagtacattgttcccacctgcttttttggagggtgggggtttgtggggatattttatctatgttctagatatagtcgtgactttttgtttttgttatcctagttgtctttttatgctgttcattttacagccagtgggaaatatattttatcagtgttttttttttttgcatctgttcatatatcatgtggcttttgtcctttactatgttgctgtgattaattatattactagaattttttaaaatgtcaagtcacactttccttagattaatggaacttggttatgatactttcttttgggtgtgttgttagatcagttttcagttattgtattgcttataggataattgttctaaaaatgtcacaaacacatctatattcttaagctgttttggtaagatatttctaattatctgttttcataatttaatataaagttgtttataatggtagatatcttttaaacctgtgttcaatctctagttatatcttctttttattcctaatataattcctgtatttgtatcttctatcctttcttttacttgattggtattgctaaaagtatgtttttctcttaagtgatttgtaactacactttgttgatcttttctgttgcatttttttctgttaatttttgcttttaacttcaacattttctatcttctgctttctttgggttattttgctgttcttttcctaacttgtaagttagtctcttagctcagttttattctttaggtagttatcttcaaattttaaaaaatacttttaatcaaaataattttaattattttaaatttaattgttataaatattttcaataaaaaatatttttctttataatgcaatatagaaaagctcataagtcttaaatatgcacaaggtaaataaagtcatgtatctacaaccagaaaaaaagaaataggatagtctcacaacagtgtctgacatatactaacaattcagttagtgtttgcttttgctactattaatgttagatgttagtgaaaaccatttttcttttaggtatcctagcatattctccaattaatagtagttttgtgtagcaaacagaatcctgtgaaattggaaagagcaatacttcagagaggttaggaagaatctgatttagtgaatatgaatagttcagacttcattataaaaaacaagccagtctccttttctgttacaacttgcttaacaaaatcattcatgtgtttcactttgtaatttcttataaaatggcttattcttttcattttttaaaggtcagatacttcatactgatgtggtttacttgcattgtggacaaggcttccgagaggcggagaaaataaagacacttttgctgaatttcaagtatgaaaataagtaatcttttgaatatatcagtggctcagtcaaccagagatacctttgaagcccctaatttggagggagggattaagggaggtgcctttgtgagagacaataaaccatataaaacagttctggggcaaattgctggagaactctgcatgtggagacttgagaaacgctgctcccttcctttgccaccattacaaataaaggaggtaatatgggcagatgtgagcagttcattcttctgttccaattttctccctctctccctgccttctttccatctgaggaatagatgtggttatagttagaagtttcagaaattgacaatatattatataatttaatcataatatctttattacggcttagatggcttagaatgctccagagttgacttatctctgattttggttccttcttgatgggaagaaagctgacttttttgagatagtgtgacagtaaaatacttctctgctgcctcctataccaaatgcagggcagtgtcttttattccatataagtctgtgttttccttatgcaacagtggacaggttgcttgtatatatgagagaataagagaatcatataatagtatttgtgcattctgtacattttctccagctgatttcaaagcatgccttgaaattcagtttgtcattctgtttctgccttgaagctgcagcacagtagtgattggaaatggaactgcctgcagggaaacagaagcttactttgctgacctgataatgaagaattattttgcaccactggatgttgtttactggtaaggctattacatatatctcttttcttggagaagcatgggaactttaaagttgcttttgtgatgaatcctcccttctctttttaagatgtacatcttctttgccctccagaccacctcttggtgttcatgagaactttgcaggataatgtaaagtgtctgactcttggagaaatttgagacaggaatgattagagcaggacagagtccagaaacctcttacagaagcagcacgttagggctcagtttcattggattttctaggctatacattgtgtgagggttctagttaactattgaataataagtagaatgatgtaccaggctagcagctagtagactgtgaataacttagcctttttctcccaaagctttgaagcctatgaatcattacccttcagaactgagagccaaggtaagtattatgaattaaaaagtatttccagtattctttcctcatttatcccttggtcacaaacttttatttcatataggcatacagataacttgtgaatagctttggattagaaagacccaatttctctagtcttgcccctgcatttgtagtagttctgctttctttcaccattgtttccctacttcctctttggatctcaatagtcatgtcttccttttccaaactatagtagaatattaagtcctaaaggatttaattctaggagagagagtagttataatggctgatatttaacagaaagtgatcaagagctatctcccactgctagtgagaaaactaataactaaaagaatggttgactgatgagcaggtgactgacaggatcaacaaagtaacagaaagtaaaacctaacacaggaagaattctaggatttgtgtaggtaggccaaaaggtaaaggccaggcagttattatagtcaagagtgccaagagtgtagtcagagtcagtcagaaaaacaaactcagggtaacaaggggagtaagagaaggtgaggaacaaaccgataggtgccatgggatcatgattcaagaaggaaacagattgaaacatccactgcagaatttttccctctttctctggttgtaatttaagttggcctgggaaatacggtggatcttccctattctgggaactgcaaacgtgcacccagtccttttgagaaactaacacaagcactgatgtagctggttcagtttatttcaggtaccttctctgatttttttttaacttgttcacattaatttcatgtaaatatcttgcatacatttgtagtggttataagtacaactttcaaatcataaaaaatattaagtagtgaagatgtcttcagttttttcttcatttgcttatagaatatccctttattgaactttaggcagtatgtactattagaaaggaaaggatgaactgtggggtcagacaaatctgggttcatctgttttttttttttttttttttttttttttttttaattgagacagagtctcgctctgtcacccaggctggagtgcagtggcacaatcttggctcactgcaagctctgtgtcccaggttcatgccactctcctgcctcagcctcccgagtagctggaactgcaggcacccgccaccacacccggctaattttttgtatttttagtagagatggagtttcaccgtgttagccaggatgatcttgatctcttaacctcgtgatccgcctgcctcagcctcccaaagtgctgcgattacaggcatgagccaccgcgcccggcctcatcttttgttttaatcatttactagttatgtaggttttgaagagttacttagcctttcttagcttcactttccttcatttttaaaatggggaaaagaatacctaccttacaggttttttaacagtattaaaagtgagataacataaattaaaacactaagggtttaataaacaatatgtttttttatgagtgtgtttgtatttgtttatatacgtacttttattataaatataaattatatgtctttaaaagtgctgtgaaattagatgcagtattttcttatgcaaattaataaacttacataaagtttattttcaccttgatgcaatagggatgatagtaaaatctaccactttggatagtaataatgtctatcgtacttgtgtaaaatctatgtattgtggtatcatgagatgttcagtcttattaatggatatgaattagatgccattttagttgagcctcaccataggtgctgtggtatgaagtgaagtatgtgggctatagagacgacctaggttcaggcctgccacctactgcctctgattagccatatagttttaatcctcttttagctttagcatcttcatctttggaaatgttacttacctgttagcaccattgaccactgtgaagatttaaaatggaatgtgttatgtatctcctatttttaaggctatttgtagtaaatatgttaagtgtgggctaatctttgagtttagggagaccccattaatataaattttttttttttttttttttttgagccggagtcttgctttgttacccaggcgggagtgcagtggcgcgatcttggttcattgcaagctccacctcccaggttcatgccattctcctgcctcaacctcccgagtagctgggactacaggtgcccgccaccatgcctggctaatttttttatagtttttagtagagatgggttttcaccgtattagccaggatctttggtgccttctttgcacttttatgaatatagtctctattaggcattttctttcagaagagccccattttgttgcaatttaagacttgctttggatggtagtctttctcctatagtctgttttctcctttctgctataattatttgggttttaaaatctacccgtgtggttaattatggtagctattttctacagttgaaccatttttgcagttctgatttaactctacttacactgtattagtcttttaatgtactttttgcatttgtttgctaatatgtgcttttgaagtttttaaatgatgcagatatctaattggaatttatagcaagtgctttagaaaaatcagctgtttaatttcattttattatcattttgccaattcaaagtgcctgtttgagaaaaccatgttttctcatcttacactttgaagttacactgaaattgaaatctccagtctttctctggcagccatttttaataccttctgaacagataatctgataggttaatctataatcttgtcagccactcatcctgaaaaaccttttccagccatatctaccagcacatttcctcttatctgttccttccaacactctttgccctgacatgctgccataggttaacaaatgccatgatatatatcctaattcataaaccccaggaaacctgacccattcatctgtcttttctctcattcatttctctccctacccttaaaataccttacgaatcatgatacttacacatattagggggcaagtcatccaaaggtgcaaattctaattaccaaaggagcaaaaagttaaactggagttaagttgcagaatgtaaccatgctgagtctcagttatcacatactgaattgtgatagttgaagttgaaatgttcatgaaaaaatgaaagttgaaaatgttcgtgaaaaattctacagttttatgggtcatttgtttaaagtatatgctagaatggtttgcagttttcaatcttttgacatatggtaggcactcattttgcttttgtagttatacattagtttgtgttttttagatttatacataatgaaatcatacagtgtataatcttttattggcttctttcatggagcatgattattttgagatttcatccttgttgctgcagaaaccagtggttctttttattcctgaacagtattcattgtttggctgtatcacaattagtttattcaatcacctgttgatggatattcgagttgttgctagttttttgctactaccaataaagcagcatgagcattcatttacaagtctgtatggatatatgctgtcatttctcttaggtaaatagctaggtgtggaaagtctgtgttgtgtggtatatggtatacggtacatgtttaacttaagaaactgtcaagctttttcccaagatggttgtaccatcttactttcccaccaacaatgtatcagaattctagtggtggcagtggcagcccatctggagcagctgctgggaagacactggctgcagcaggggagttgtggcttgggttgcatgctccacaggtgatgggagccccacctcctaccaggttagtggggcagaggagccccatgctcctgggcgcagttgcagctgcccagctacagctctggacctgggcatccctgcactctcaggggcctgcgatgccccttcccctgcaggctcggaagtacctgctccacctccctggcctctccctgctcccagcacccgctccagaacagagcaaagttgtggccgagcctaggcactgttgcgacctggacaggtgtgcctgcactcgaggcagtgctgacaccagcccctgctgcctcagcctgttcaggattttgggcaccaaccaacacaggagtgaggctggggtggggtgatggctaagggcagcttggcacaggcctacaggtgtcccctggcacaaacagcccatgcaccatggatgcatgctgatggtgggaggcagacattcctgtgcagcaaggggcaggtctcagtgaaacccccacctccaagccagggcctacgtgaagtctggaggccaggttgccagttctgggtggagtctgtggccgggagtgtgaacttatggtactttttccagacatgcccatggctgcccatggaccaatcagcatgcattcctcccttctgagcccataaaaaccctggactcagccagactgacacaaatgttgggactaccagctatgggaaggagccacccactttgggtctgctctctgctgagagctggacacttgtcaggagacctgtctgcagaatggggctacccactgcccatctcctctccactgggagctggacactcattgggataacctgcctgcagaaaggggctacccactgtgggtctcctctctgctgagagctagacactcattgggacaacctgcctgcggaaaggagctgcccgctttgggtcttctgagagctgttctgtcactcagtgaagttcctctctgccttgctcaccctccagttgtccacatacctcattcttcttggacatgggacaagaactctggttccaccaaatggtggatctgaaacagctgtaacacaaacagggctgaaacatgccctcctgcctgccatgctgcagaccttgagaaggagaaaagagctgcagccctttggggagcccagacctaggtgctccctaagccagggctatggcaccctctttgggactctctggttcctggcatctcccaccttccaggaaccactgtgttcccctcgtccagatgtgggtgtctgcagtggtagttgcatgtgatatatctggtccagccacagccttgcatggcaccacctgccctgccacagctggcacgcctagctctgcacagtggccggaccctgtgctcactcacacaccgctcaccgcactacgcctggctcacccttggcagggtgagatctgggccagtagcaccagccaagcacagcctgccagcttgagtgagtggaacgagcccagggggcctgagcaaaactcggacaaaggcaccactggccacagaggtgtctggctggaaaagtgacaccctaaggattccgtaacactagtttctctgtatcctcaatggaattatgaagttatggtcagtgcttggtatggtcagccttttaaatttagctgccctagtggatatgtagtgatatctcattgtggttttaatctgcattttcctagtgattaatgatcatgagcatcttcatttgcttatttgccatccatgtatcttctttagtgaggtatctgttcaaatctttgcatttaaaaaaatggattgttttccttgtgattattgaataagagtatttttatttattctgaattaagccctttgtcaggtatatgtttcataaacattttttcccagtctgtgacttttcacttttttttaaacaggatcttttgaatggcaaaaattttagttttgagaaagtccaatttatcaattttttggtatagtttttgctttttgttttctattctggaaattttggcaaaatcaaggttactgtgattttcttctgttttgtactagaagttttatagttttaactcattaagtctgtaatttaatttttggagaattgacatccactcatttaattttttttttttttttttaagatggactctctctctgtcgcccaggctggagtgcagcagcacaatctcagctcactgcagcctctgcctcctgggttcaagtgattctcctgcctcagcctcctgagtagctgggattacaggcgcctgccaccatgcccagctaatttttgtatttttagtagagacagggtttcactgtgttggtcaggctggtcttgaactcctgacctcatgatccgcctgccatggcctcccaaagtgctggggttacaggcgtgagccaccatgcctggcccattcaatttttaatttcagttttatttttcatctagaagttctgtgtttttcaaatctgcttgatgattctgtcacttttttcctggctatattttcaagcctgtctttttttaaaccatgttaaattttgcattttacaatctgtgtaataattctagaatccttgtaattttatttctgctatatgctgtaattgctggttctgctttgtgatgctttctttccttttttgttcagttcttaaggtaagctttttattttggtggaactttgtgggaattcatttaggcctggactgatggtaagttgcttcaaagaggatttgcatttgcttctgctacactcccttagatactaccagtttgggatcacttaaattaaattctcggcttgagtttttttctgaccacccaggtagtgtgaatttaggctgcagaccagacagatggcttatagttccatattctcatcagtagttccccgctacatcagcccgtgactgagtttgagatagtccattttcattgtgatctcctgggggtagagtatagtgagttatagttctgttttattcttacactgagggtttaacctaactctggagtcctagctttacatatgtgagagtaggtgggggatcttttgttaacatctatatcttaggtggatcctgggttttctattttattcttctggttctgtgaagctctgtgaggccatgaaacttgaaaataaaatgcacttggttcagcagatgccctcagctgaaagtcagcttcagaaatcaaggttcccacatatacttcattttttttttttagcaaaaaaatttctttcttgccaactcatagatctctttaagaagataggtcttttagttgttttcagtgaaagatgaatccaggtagctcatttctcatattggttttgtattttaaattttctttaaatgtaaaatttgctattttccgacaccaaagtaagaccataaaaaaaaatagataatgatcttttcaatcatctaaatttacacttgagttaagaattacttgtttcttttagttctttcctcaggatatctatgcctgtggaaacatgtacatgatatagccttcattctctggcaatttaatattctttttttttaaaggatgcttaagagggagatcttgagaagtccagaaaaatacccagaggaaaataaaaattattggtactgtcattactcagagaatcatattaatgtttttatatattttcttgtagttattttacttatgcattcatttattcaacaaatatttatcacctataaatgtcagattgaatgagatagactcagtaaggtacaagaagagaacaactttttctttactacctcctctctttattcaactcatgtttggatgaactcatgttcgttcctggctgaaataatggacaggtctcatagccttttcagtccctcttagttattagcatagtctcatttcagcagttgaaatatcttctgtagtgcaataatcagagatccaaacttgagataagttcaattaaatgtcaggcctctttcactctggaagatgctacttcactatcgggatttgcaggttagtttatcgggatatgtagttagtgtcctctctcttttcctctttgttattcttattttccctaactcactagctgaattttctgatccctctaagtttagtcctcagagtggagtagcatgggaaaaaagagcatggtcttaggaagtgggaccagttgcattctggggtaaggccctctgggtggcccaaatacaattgctgatgcttcctttcatggggtgttatgaagaatttttctatttttgttttctgagatttcccttgcaaggaagctgtgatgtagctgatatcttctttggttgactggttatggctttccttctctcgccctgggcttcagaccagccattctcatctgcgttacttcgctgctcagtcctcttggacagaatctgttgaaagcctaccatacacttcttcctgcaggcccatttggctcatacctccttgcctgctctccaatgggtatcaacagcttatccttagcacagctgtctcccttttaaattttctctctcataccttaggcttgcacctattctctttcttacccatccttgccttcctcttgtacttttctgtgctgtcagaggtagctcttccttttcatttttctaaggcatgtttagcactccatactctgggagcatatgtgaagctcatgaagtgttcccagtaaagcgccttccacttggcatgtgatggatgagatattcttctatgtgaaatgttgagagagcaggaaaaatggcatagcatcccaatcatcttcccaaagaaattttttctctcaagtctaactcttgtccctccccccaaaacacacccattttataggacacagatgaatgattgctattgttggcaaaacaggcctttgatgctttagctagaacaaaaacatcccattactcctgtttcgatcatccagtcagcagagtatccctcagaaccaagactatgttacaggcacagtattgtgtgctgggaaagaaagcagtacaggcaaagtccctacccctcttgaagtttgcattccaatggagaagacagacaaaaagataagagtgtgtgtatttttatatatgtcagttggtgaaaaattctgtatcaagaattaaaagcaaggtaaggcgatagtgacaagaagtacaatttttaggtaagtataggtataaccgatattcttggtatatgagacacattttaagaagactccagtgctgaagtaaagtgtgatgaatttgtgtcctcctttatccatactatccagattcatgttctctttatcctcatttttctgtgtcgtatgagcctatgtttttcagattgtaacttgtaacccattggtgaaatgtgaagtccatttagtgcgtcttaaccagcatttttaaaaagttaaatagaaaagaataggaaatagagggcatttcatgcagtaagctaagtattgtctcatgaatatttgttttggttacatgtatatatgtgtactgggttgtgatgtgtttcttatggttgatcataaaagtttgaggaacattgctctatgaaattacagttttcagcctttaaaaatgcaaagttaagagagaagattggcccgcaagagtctttactgagaagttagaaagcttttagaaataaaattcagactaccttatacaattgcaaaagatcctctgaagggaagtaaatagaggaatggttctgagaacacattgggatatgtaagctggacaaatgtactcttccagtaaaataatgagccatgatccttaccatattccttggaaaaaagttaaattaatggatagaattttcccaatctcaattaaaattcctcatgtcaaagaaaactttacaaatactttagttattaacacatgataaaactttattataatcttatttcaaggcaaaaggtttttaataggccaattcagagatgcactctttgtaacaaaattttatggaaaagagaacataattccagtagagaaaaacacaaataaaaatgtttgggtgattggtttgctagaacaagtcttctacctattagagtatgtcagaaaattgcttaagtattctatcaagtatgtttttttcccctagaagaaaaaaaagaaaggaacctttcttgtatgaattatgtcattcatacaagaaagtttctttgccaaaccaagtttggaacaatttatcttacatttatgtatttttcttaatttgttggtgtctactagtaactagtatctgatttagctcttatatgtttaattatattatataatatgcaaatattctgttgtgttctcagtagagcacattgacttccaggggctttgcaaccagaaaaagattaggaactaaaagtaaattaatttgtatgtattgactgcatactccctgccaggtgtggattttacaaggacatatacaaagctgaaagaagtgtaagtaaccaagaatgtgtgtaagagggaagttactgatctgttaaaaatagttctggaagaccaaaatttaagaactgaatccctccttttcctgcttccccccatgtatagcataaaagtcttttaatgattatctttgggtaaagagagttagaaaagaaatctcattgcttctagataatatcataatcctaatcagtggataaaagagtagacttgttcaacttctcttttgatttgtgagataggatgatttggggggctgaaaagatgaataagtatcaataaaagaaaactaaaacataattaaaataagatattaagagatcttctgtttcttattttatcttctggcccagatgaaacattttctggagttctgggtggacttgtacctaaaattttgataccactattggtaattgttgagaaattgtggaagcttggagatgaactgatgttattttgttgttccagagggaaaataaaataggttgtatagatgactgagtgtaatcttggacaggtaagattattattaaattataaaggaatggttgatgagcacttaggtaggaagggacagtagaaaaataaccactggacatcaccatgcgtttcttacaaataaaacattttggtcttaacctatttcattttctgttaggaaaattagactggtagaaacatctggacctcagcacagctattgatagtctcttaatacccttatggacaaagtggagatttggttatgtggctcccaaaaagatgttgattagctaatgtgttgatgtctggtttgaggtctctagtgtgccacaaacatcctattagttaacattttagtcaataattcagtcaagatttggagacatgcttttcaaatttgtggacactgaggtgtgttagaatcagaaccaaaaaagtttttgaaagacttgagtttttggacctaatctaacaatatgaattttaataaggatacattaattttgtgatggtagggggaatttttggtagagatttttggatgatttctcgggtttctttttactctgtgggtgactttatcagaataatgtgcagcagatctcccctgtcctgaaccacctggacctttttcttttgctttggtttaaagaaacttactttccaaaaaatcagtagacttagctatataacttaagatctatttagctatgtaagttcataatgttatgaagttaatactgttttatatggaggaaaagatgtggttggtgttattaatttctcactagtgcagtattttccgtttcacaagtggaatttgaaatcaggatttttgtatttaaatatcctgtctcctctatatgcagttttctaggaatgataaaaaccataaatcatccttggaacttgggatagcctaaattgttttctggatattaaaactaatatccagattatcatgcctaatgacaagttaaggtgctgtgttatttaaatttctcatttctttctacagtgatggcttgagatgatgtactgtgacattctagaattttgttgccttttctttattgatattcatctccatttcggtgactattatgaacactgggctcttgtttatagtgtttcctttctaggatgtttgtgatataaggtaaattaaaaaataaaactatgttttacagtcaatacaatttatgttcattttgttgaaaggcagaatgtttttaaaaatacatatttaaatagaccatttcagtgaagtatgttgggaaaggagacataaggaatgaataatttggatgtgtgtgtatgtatatgtgtgtgtggttttaaaatactatttggatttgaattcagtttgactgtttttgatcaaaataaaatgttttaccagttttgtaacccatgtgtttttgtgttcgtaagtccaatttaaatatctgcaggagttaccccaccccctcactgtagcccctcttgcagatctttgtttattgacttagattagaaatggcctaaagcccagtgatggtcatttcttgttttaagatttttggttacaaatctgcttttgttgccagatccaataaagattcttgattgtttttgttagttttaagttcttgccaaagatacaatgtattataaccaaaacagatgtcctgtttagacaagtatatttaggctctaacagaacctaaaatgtaaattaaacatgttcagcattaatgtagcaattgatgaactttgggattgtatcagtgtttttgataacctttagaagtggaggaaacaatgccttactttttctctgtctaatctgtttgcgtatgtacagttttacactcctagatactcctccaaactgacattttactgccattttgaaaatagagtggaattcaccaatttcctgtatacaattttgttcttaaagagcatacatcagattaacagtattttctgttagagagttcagttgagtagaaaaggatagtttctgagactttaatgcttgtaaataggtagatgaaataattatatatagaccctcttattaatggtgttcttggtgaagttaggaaccatattagggttgtagtgtccatcctttaggacttttagtaaccatctctgtagatagggtccagtgcagtcttaatttctgctgaattctgtgttttggtgaacaacaggtaatgtagtgaattcaagatgaatgtatttctattaagcagtgttagctctttttttccatcatagtttctagggtaaattagatgtgtgagggatatatcaattgctaccactggaaccatttttactttaagattgttgactctttggcctattcttatccatattttcctcttttctttgggattaaacagcttactgttttgcctcacctttggccaacacgttttaaaaaatgtattcagtttcttattgagggaatatctaggttttttcttaaactgggttgtgaagaattattttggttctctctctgattttagttgcattagttgaattcaaaattactgaaatcctttgttgagatccttttcttttggttatatagaacttggagattcgggggccagaaattgatagttgaaaacagtagttcttgaattcaccttatttgtgttttatatatcttttggctgcagtggggggtcggtaaaccttttgattctgtgtattttatgtggctaaatctttgtattatgctctcctaacttaatgaaatacctcttttaagttccccacatccgtacatttctaaggttacgcccagtttaattcccattacttttccgcttcatagcacttgcattttgaaggaaccctaacatttgggttcacattatgataattaggtttcaagggcatgggggattaaagatatctcaggtctagttgcagaataaagttcagaagcacttttaaaacttgcctgattggtgggtagaggtgcttttatttattctctactcatgcagcattaatccctatttcatcaggtacctacagtgctgtaattctagacgtgaccttgggtcttgatttacttcagctccgtcttctttataaatgtgccatgaaagaggtacatgaaagatagccaacatcaaagcgccttttaaagtaaattggttgataggaattccctggtatttaacactgtctgtcaaatgtttcagctggtttgcatccttttacaagctattgcttgctgcatgaaaagaaatttaaagcagttgttttaagtcttggggagggtggttgtgatggtgctgatggtgctgatggtggtgatggcagcggcatggcaaaagttagccagagaagagagtaaatgagaagttaagaacatgttctttttcagctgtgcccctcccaagattgtttttgtgtttttctttgggttggagagtctttaatacagtgcttatgattaagaggaggaggcactcatcttggttatcagaagattgaagagggtggccaaagaaaagtcatcaaactttagtgaaagaaagaataacaggcagtgtcagtatcttattcagagattgttcaaccagtttaacttccagcctgtttattctttattgagtcatatgagaagaagctgtaaagtgggaaactgagtctgaagaaagaacaaaggaaaaaggactcagagaaggcttgccatatgtattacggaatatttattttcctgtaaacatgttttagaggctgttgtctgttctaggcttaatatatggggtagaacttcttacagctaagttttgaaaccctggttacttctttgtttcataaatattatttggctgtttctcccaacttaagaaaaaaatatttaaaagcattttattttttggattatcaccatgattgtctttggatctattcctatcgtctttactgtagaactttcttaatctgaatagtggaaaatagaaattatggaatgttatagaagatatttacttgccttcaaatatatactttattttcagtttactgatgtaaccttgacctgtagagatctttaaaaatctattgtaataaaaacttttttgtaaatagtatttttaatgtgcgtttttacgtattgaaatgctttaaagtcatatattctcttgacattctgtaatattgttttcacttacctgcttatctttttatttatatacggtgagtatggaaataaatttcaatccagacctggacttgtcagttagttgaattaaagactttggcctgtaaaggataagaaaccaacacaacaactgacacagaggcgtttggtagtgaccttttcttttcaaggaaagcagatatttgagacagactgtaaccatcagtatagaatgagctactgaggtttcttggggttttatgaagagagatagcctagtatgtgtgtgtagggagcagtatacgcaaattatttgacaattgattctgtgatgaagaaagtgggtggagaggtacatcttgcccatttgtctttgttttgtttttgtttttgagacagggtctcactgtgttgcccaggctgatctcgaactcttaggctcagccttttgtgagtatctgggattatagatgtgctccaccatgtccagcttgcccctttgttgacataggcaaagtagaacatcttactgtcattgccatataccatatatggttcagcccctgtatttggaagagtgacctctgggctttagagactgatactaggaactgggtagtagaaaaaaggttggaagtgctatacctttctattcatgccacatttcctttcaacctctgtcctgctccccttcacagttaatagcatcttctttcatatataggatgtgtgtctttaataatttgatatgacccatcatagtcatagacaggagacagtgaagcatgatattgcttagaaagttaagatcttattttgtaagcactttaactttcctgaggtggacagttgtggagtcctttgattgacttttgattcatgctgctgctgttgcttttttcttttttaaatattctgaggttttgtgtatcctacgtaatttaggatcagcattgttatagcacatgaattggccttagtgttgtgttgtcattcaaatatattaattacaggctagtccaaagcttgattaataagagtccacctagtcaaggatcgtaagatattacttagtgataagcaacttgagcttgcaaatgagtcatcaggttagcagttaatgggtatatttttgactgattcttctgtttactcaattagtccatttacctgaaattcccactaccttttgaagcatttttctttttcctttcaacataatggttttcctcaatctaggactacataagaagtttggtaggccactcttctaattcctggtttgaatttagatagttccattgtttaaaccatgctgctgccatcattgccattgtcatattctacttcctattttaagttatgtccagcaatatattaggaatatttctggctcagaattcagattttggtatcaccaaaaatttgagggatacagatgcaaagaagcctttgtactgtctttcataaggagaaatgctttgaggaagtctttctattcttgtatgctgtaatttctagcatttaatgatttccttgtcttcaaggttctaggcttaatttgagttaaaattcactgattatacaagaggaacccagatacctattttctttcttctcttctctcctatttggggaatccctaactcaacccatttgggagactctgtatctggttgtaaataggaaatactgcttttagatggtttagactttggtgagaaaagtaataattaaaatttctaccatgaaatcagattttttttctattttaataaaatttttattgggtgcagaaagactggaagggtgttagggacccctgttcaaattttcggattttggacttgacatttttctcattcaaggtttttggtagggaagtataagaagtggataaagaaagcagacctaagaatatgtcagtaacatattgggcctttgaaatatcttagttctttcaggtttgatttgtttctactcttcatttttttactgctttttccccatcttccttctgactacattttcttagtgagaagtgacaggtttctgcttactgggaaaatgtaaaatgtatctgtcttattgaatttaatatcttgggggatatttgtctccaaaatctagtgcatgcacagaatccttttttgtcattatatagaagggaaatacttcttttaaaatcctctctacagttaagcctgaggtcttactatagtactgttaattattgacattttcactaacatattcaggaatgttttggttatattggatgattctttcactttgactatcaaaatttatttactcattcacacaacacattttttgagcacttctatctgtacagtgcttggcatggtagagtcaaagatttgtaaaagcatatccactgaccattttatgtttaacccagcagcctcttctaagctgtagcttatctagattccttttcagtttcgtacactgctgtttttctctcctgcttttggtaattgtacttctaagcctgttaatcattttttctaggcattcttgtacctcttccccactcttaaacttagacaacactccagatattttcctcacccgctttgtcttctctgtatatcttcttttccttgataatctcttcatccacttctggagcttcatcttttgcatcttgtgggttctaagtctacatagtttcaagttctcaccagagacatggactcagattcagtggcttatgctagtctctagagtacccctctggtacctcagtttcaaccaaatttagctttttgctttggctcccaaacctattttttatgtgttttttaaattcttttataagtccctcctttactgatgttaattctcttgggcacaatgtttgtactctttgatttcttattctgtcatataccccattcaaactaccatgaagtcctgttgattctgtctctgaaatgtgtctcctatttcttccttccagttcttcttgtttaccattcttcttttgagatgttaaggctttcatgagctggcctcaacctacttttcatgtatagtctcttgatactcgcttcttaacccaacacatggtgttcatcattcaagcatttataatctgggtctccgtatttatttttacattatgccattgtgatgccatttattaaggaatcatacagtttaaagaattatgtaatcaacagtttattcattataagaattagcccagagttacagttacatcctatattttattaaatatataagctaaaacaaatccattttcaacattgttttattattcaaaattgcctcagctaaatctctcctgatctgctcctattatttacaatgaaattttggctcctgttttcagtggcttccatttaagtgccctttcctttcataccatgtattctcagatagcaatgattcctataaacaaggtaagttggaatttagttctttgaatgtgttaggtggaagttttctacccttttgtagttaagagcataggctatggaaccaggttcaaattatagcttcatcctttactaccatggtgactgtgcttaagttacttaatctccctgtgtctcttcatctctgaagtggggataataatagtatctacttcgtagggttttcttgaagattaaattgaatagtacattgaaaaatacttagaatggtgcttggcacatagtatacaatcagtaaatattagcagttatttttattataacttcaaaatgtgtaataataattattatttttgctcatcctgttttcttcccttggtataccctttcctcatcctctgcctatcaaaatcttacctatccctcagggcctgactcagatacattctccatgagattctctaatttatctcaggttagaattaatctcaccctcatctgtgctctcctaaaattttctgtgtacttccataacatttaatatatagccgcctttgtactgtaccgatttatgtaacttttttcggaaattcatttatgactggggtaggaagaatcatcattgttcatccctttggaagatagttcactgatttgcccatgttggcactcagaaatttgaattgatttaaaacttgctggcccccctcccccacacataatgtatgtggagagtatgtatatatattcatatttatatgtaagaaccttctgtgaataaggcactcccataaggactatggaagatataaaaaataaaaggtatgcttttcagattaaagctacattttaaaaaacatttctaaaaactatggaaacaacttaaaatgattaaatgatctgtgttcccagatcgcactcagcttaagacatgtaacgttatcagtacttttgaagtccctggctgtcccttctttttcacatctcttgtcttcccctccgtagctattcatgctcttgagttttgtgttaataattccattgctattttgcatgtttcctttacatgaatcctaatcttctataacttgatttttcttccttaagattattttatattcattcattttgatatatttaactgtgattcattttcagtggtgcattacataattatacaatatttttctatttttgagttgattgacatttggatttctgattttttttattgtttttggaagtctttattcatttattttgtttaacagttttactgagatattcacacaccatataatttacctatttgaagtatataattcagcgatttttaatatattcacagatgtgcagctatcactactaattttaaaactttttcatctcaaaaacctgtacactttagctctcactcccttctctcccatcaccgcattctcaccttccctactccagccctaagcaaccactaatctactttgtctctatagatagatttccctgtcctgaatatttcttatgaatggagtcatattatgtggtgttttgtaattcacttctttccgttagcatgttttcgaggttcattcatgtcatagcatgtatcagaacttcattcctttttatggccgaataatattccattatatggatatacaacattttgtttatccatttattagtcgattgacattgagttatttccactctttggctgttatgaataatgctgctgtaaacattcgtgtacaagttttggtgtggacatatgggctcatttctcttaggtatacacctaaaagtagaagtattgtggtaactctgtgattgtttggggaactgcagactgttttccaaagtggtggcactcttctgcattcccaccagcagtgtatgagggttctgatttatctacaacctgccatggttacctgactttttgggtttaaccatcttaatgggtatgaagtagtatatcattgtggtttttgatttggattttcctgatgactaatgatattgagcacttcttcatatgcttattggcaatttgtatgtatttcttggatcaatgtctattcatattctttgctcatttatttttagaacctaataaaacacatgatagtatgtttaattggtggttttaattctttaaaaaatgttaatattttcttcaaattgatagtaaaaatcataggtatcatgtacaacatgatgttttgaagtacatatacattgtgtaatgactaaatggagctaattaacgtctatctgcattaccccacatatttttatagtaagaacactttatatccactctcagcatttttttaagaatacaatatattgttattaactatagtcaccatgttgtacagtagatcgcttaaacttattcttcctataactgaaactgttactattttttatttagataatttgtcttttcattactgagttgtaagagttctttatagttctggatacaagtcccttatccaagtgtatgatttgcagatattttatgccattctgtaggttgtcgttttacatttttgttgattacatttgaagcacaaaagttttaaattttgaagtccaacttttctattttttcctttgttgttcagatttttggtgccatatgtaagaacactttgccaaatccaccgtcataaagatgagctcctatgttttcttctaagagtttaatagttttagtgcctacatccatttagttattgacagattttgagttaatttttgtacatggtgtaaagtaagggttcaaattcattttttttgcctgtggctatccagtagtcctaccgacatttgttgaaaagactgttctttacccattgaatgatcttagaaccctgtcctaatcagttgaccgtagacatgtgtgtttatttgtaaactctcagtcctgtttcattgatctataagtctatccttgtgccataaccacactgtcttgatttttattgtttcatagtcagttttgaaattggaaaatatgagtcttctactttgttttttctcagattgttttggttattcagcatccccttcaattccacttgaattttagaatcagcttgtcaatttctccaaagaaatcaactggaaatctgatggcctttgcattgaatgagtagatcagtttggggattattgtcctttttacaatcttaagtctttaaatccataagcatttgatgtctttccacttatttagatcttccttaatttctttcaacaatgttctgtagctttcagagtataagttcgatacttcttttgttaactttattcctaaatattttgttgttcttgatgctgttgtaaatggaattttcttatttcatttttttaattgtttcttgcaaggatgtagaaatagtcggtttttataattgatattttatcttgcaaacttgttgaacatgtttattagtgctaacagtttttagtggatttcttaggattttctatatgcaaaataatgttatctgtgaatagagatcatcttcttcctttctactatgggtatttgtcttttatttctttttcttgcctaattaccatagctagaagcttcaatgcagtgttgaatagaagtggcaagagcagacattctcatcttgttcctgttttaggggaaacatccagtctttcatcattaattgtgttgttgactgtgggtttttcctacatgctttttacctgatcaaggaatttcccttctaattctagtttgttgagtatttctatcatgaaaagatactcccttctgtcaaactcctttttttgtttctgcgatcatatgaattttgtttttaattttgttgacatgattgtatgtactgtattaattgatttttggttgttgaatcagtcttgcatttttgggataaatcccacttggtgatggtgttgttggatttggtttgctagtattttgttaagaatttttgcattcatattcataagagatattatttggtatttttcctgtggtgtctttttttgattttgatattagggtaatgttggctttttagaatgaattaggaagtgttctcccctcctgttttttggaagagtttgtgaattgatattaattctttttttaaatgtttggtagaattcagttttaaaaccacctggattgtgggtattttttttttaattacaaattcagtatccttatttgttattggtctattcagattgtctatttctttttgagtcatttttggtagtttgtgtctttccagtaatttgtcagttgcatctttgttatctaatatattggcatacacagttgttcttataataatttttaattctctaaggtcagtaataatgtcccctgttcatttctagttttagtaatttaagtctttctttctttctttttcttggtcagtctagctaatggtttgtcaattttgttaatatgttctaagaaccaacttttgagttcaactttggagttcatttctttattatttttctcttctttgttttattaagttctgctgtaatctttattacttccttccttctgcctactttaggtttagtttgctttttttttttttttttccagcgttttgggtggaaggttgggttattgatttaagatgtttcttctttttttaatatgggcatttataactatagttcttagctatatcctttagttttatttcttaagttttggtatgttgtgttttcatttttatttatctcaaagtatattttctaatgtcctttttcatttcttttttgactcattaattattctgtttcatacacatgttgagtatcctttatatcacatgcttgggaccagaagtttttttaagatttcagattttagaatacatctgacccttgaacaatgtggaggttgggatgttgaccccctctgtgtagtcagaaatttgtgtataacttttgactccctaaaactagtaatagcttactgttgactggaagcattattgataacataaacagttgattaacacatgttctgtatgttatacgtcttgtattcgatattgttacaataaagtaagccagagaaaagaaaatgttaagaaaattgtaagaaagagaaaatatacttattattgattgagtggaagtggatcatcataaaggtcttcatccttatcatctttatttgagtaggctgaagagaaaaaggaagaggaggagttggtcttggtatctcagggatggcagaaatggaggaaaattttagtatgattcaaacccatgttgttcaagggtcaactgtatttgcattatatacttaacagttgagcatccctaatccaaaatgctccagtgagctttcctttgagtatcatgtttgtgctcagattttgggccaggcaccatgcatggctcatgcccataatcccagcactttggaaggctgagacaggaggattgcttgagcccaggagctctagattagctctcgcaatatggtaaactccatctctactaaaaataaaaaaattagcctggtgtggtggtgcatacctgtagtcccagctacagctacttgggaggctgagctaggaggatcacttgaccctgggaggtcgaggttgcagtgcatgccactgctctagcctgggcaacagaatgagaccctctgtcaaaaaaaaaaaatttcagattttggagcatttttttattttagatttttggatttgggatgctcaatctatacgatattttgtttatccatttgtctgttgatgtacacttgggtgattttcacctactggctattgtgtatagtgctgctatgaacattggtatacattatctgtttgaatctctgctttctccttttttttttcttctttctttctttctttctttttttgggagataggatgttgctctgtcatccaggctagagtgcagtggcatgatcatggctcactacagcctcaatctcccaggctcaagcgatcctcccagctgagcctcctgagtagctgggactagaggcacgtgccaccatgcctggctaatttttaaattgttttgtggagacagggtttcaccatgttgcccaggctagtgtagaactcctaagctcaagtgatcctcccactttggccacctaaagtgctgggatttgaattcctgctttcaatccttttggatatatacctaggagtgtaattgctggtaatatatatgtaggagtgtaaatatacaatcaaattgtatattttgatttttgagaactatcaaatcttgagttatcataatggctgcaccattttatattcctaccagcaatgcatgaggggtccagtttcttcacatctttgtcagcacttattattttctctttttaaaattatagacatctagtaggggtgcagtgatatctcattttggttttgacttacatttccctagtgactaagatgttgaacatcttttaatgtgcttattggctatttgtatctcttaattggagaaatgtctattcaactcctctgcctgttttcgagtttggtttgtgtgtgtgtgtgtgtgtgtgtgtgtgtgtgttttcctttttgttgttgagttgtaggagttcttatatattgtggaactggcactttccccctctgtgtttctagctccctgcagtcattgggtgtcatctaggtagtggatttggaacgggagacttccctgactccccttgcaggacgtgcgacaggggtgtggcttgtctgtttagttgctgccgctgttcaaacctcttatgggagggggagcatgcggacagacagttgcaggagcccaagtggacatatgttacagtgtgttcttttagccttgacgtccatggatggcttaagtgttaaccagctcagaggaccctctgcctttttgcaagggcagagggccattgcaatagctttctgtatcccaagctgttgtccaacatcctggaagaattgggttacacatggacttgaagagtgtgaatgtgggggttttactgagtggtggaggtggctttcagccagatggatgggagctggacaaggggatatagtgggaagatgatcttcccctggagtttggctgtacagtggctgattcttctctccgaccacccccagccaaactcatcttggtgttcagatgctccttctctcctctttctctgctgcgccattctgccatttgcttgtctcttcatctgctcctggagcctggggttcagggtttttatgggttcaggataggaaggcatggtgggccaaaaggcaactttttgggcacgaaaacaagaatgcctgtatctcactagggccatggatatccaggtttgagggtggggcctttgccggggaactgccctcttctcccccgtatttccctgtctcctgtctgtagcaaattcagggatcttgtaactgtcaccagaaatgcctaaagcaaacagcctgtggcagtgtcagcaggtgctaatccatattctcacactactgcctggactggccatggggctttggaggagggtctcttctggatcatcctcactagaaccagattgatagctttagcatatgtgctcctgcagacatgggcttgacttgacccagtaacagcacaaaagtaccattgaggccaggtaccctgctgctgtttttgtgctgctcatgctgacagcttgttggactctatttggctgacatctggaacatctgtctttttaagtagtattataattgcctgggatgtaattttctatttttttacttttgtcctgttagtgtctcttgctttaaatgtattttttctaaggataaagaacttgtacagggcagtggttaagatcatcacttttctgtctgatctgcctgagtttgaatcataattccaatacttattagctttttggtcttggtttggttacttaacccttctgtgccttgttttcctcatatgtaaaatgggaataataataaatagtaaccttataaggttgttgcaaggattaaatgagttaacatatgcgagtacttagaagaaggctccattactgtatagcagagacacatgccaccttctctgaaagtcaacacatttaacaagcatcaaagatttcttgaaactaaaattccaggaaaaataaacaaaaatttttaaaaaatcacataatgtatgtgcctgagttagaagaagggacaaaattttcttttgaaccaccaaacactgcagttgtcggaattactgagtaaagaatataatgtaagaatgttgaatatatttaaggaaatgaaagagtatgaatggaataatcacctttggaggacacaggagacacaatgaaaatcatgcttaatcaaagatactcttgtaaactacttaagtggccagcacctgggtccttgtaagcgttaacaggccagatgaactttttgtttctttactttagttaaggcttttgtttccctggaccaatggcggccaaggtttagtttgaaatgtgtgggtctgaagtgaggtggtagtgaggccagtggggtccccatgttgtatagtttaggacccctgagtacaggagtatgatgagggttataaagttgtactgtttgtcttttctgggaataactgaaatttttacttatctataaaaactaaacattttgttttcttttttagtgccctccttcaggagctatcttgtttaacctttgtagagctataaatatgatttgattaaaaaattatagcttatagtcactcctagaatagctttaagttttgttacagctttttgtcttacctaccaattttctaggctttctcaatatactttgctagaaattctgctagagaaaaatggtgagattttttttttttttttttagccttattcgttcttaggagctcaccctgagaaagctcaaatctgtcatttctctctgggaaaaatgagatttaaataattttttttacttgtacaaaccaaaacagtacatgttttggcagtttgtaaattgttgcctcattaacgtaaacaaaacaagtcaaattagatatttgtgtttgaagagatttatttgctgcaatacagctgtatcctttatatagaaaatttataggttgttattttatgatctgtgctttttcagactatccctttatagtctgtccaaaacataaaaaagatgtttccttggttgattcttacaaaggcaccaaacatgttgtataaatgtaagttggaagattattaccgacttgtccttagtcatggtttccatgtaacaaggtgctgtagattaaggtaatgagaggtatgaggtggggccatgaggcctctaccagcctctaaattctttttctctcttccactccactcagcaaacaactggactgacaaatgctgccagcctagtttggaaattataatacggttctgtcattcattctgctcaaaataatctcatatagcagtgctcaagtaaattagaaggtaggtatagtggataattacttaaatattcagtagactttttgaaggggcagtatcgcacagcagagccagatatctggtttccacataaatttggatattttgctagttttatgctcttgggtgaattatttactttcagtttttctacctgtaaaaatgatgatgataatacttacaggattattgtggaggctaaatatattattgtatttcagttaatctaggatgttacccattttaagacacacctttttaagggtaactttaaggggaaaaaaagcctgcctattatgatattacactttctcatcaaataaagagagcttttgaattatcatcatcatcattattttttgagataggctccctgtcacccaggctgcagtgcagtggtgcagttgtggctcattgcagtctcaacctcccaggctcaagggatcctccaacctcagcccccagagtagctgggagtacaggcacgtgctgccagatctagctaattaaaaaaaaaatgtttttggtacagacaagatcttgctatgttgcccaggctggtctgacacctctgggctcaaactatccccctgtcttggccttctaaagtgctgggattataggtgtgagccaccacgcccagccttgaattatctagacataaattgttatcataagttactcttgtacatagaaaaaaataaaatataaactgaataaaattgaccaagttatttctgaaactcatattcagagactgagttgagagttaacttttacttaggattaacgggaaatttctgattaatgcttgatgacttagctgtatacagacttggtcagaacttgtcacattagtctttcattgccgtgaaattgctttcacctaatccaaaggatttcacagttttttctgcttttagttgctctgctgtaacctacttgttttttagtcttctttgttaccacaacatgttataatgaactcacttatgtaaaagttgagttctaattgaaattaaacatattacaaagcaatgtgatagtcgtaaaaacaggaacagagagcaataaaaacaacagaaaatgccaaagcagagctaaccatttaaaagataaaacacacatagaaaacaataggaagagaacatggcctgataacgtttgaactgaattttaaactgtttaaatgatatttaattatgatgattatatggtgctttagataccctcattactgtgtatgaattagtacaacccttctgaagagctaatttcttggtatattttaactttttgctataacattgctatgtatgtttttagctattgggctgcacactttttaaaatttaaggattagtaaatattggctaacatgtaagctccatgggtgcaggacatgtttgggtatttatttactgatgtatcctcagacataagagtgtgcctagcatatggtactcatacattgagtgactcaattaatatattctgtgttaaccagaacctatggattctaatatatcttttatttatattaacaaaatgcctttcctgcagaaccatgttaaaattccttacagcatctatatggtgagggtacttagctttttttaaaaagcaatacttttttgatgaaatcagaatgtatgtttttatacctctacacttacaaattaagaatatttttattgtttttgtggaactatctactcctgtaagcacttttaacagtacagaataatccaaagagcaatgtagagaattatctctacttccttcaaggggtaacaatcattattgtattggtgaacactattccagatatatctgttgtgtgtgtgtgttacataatttaacagtgatacctgttttttccttcactcattaatgtgttacagacaagtaccattttaaaggcttctcatcatttttaaggatggccgaatagtatcttattgcatgtgcatattttatggtactttttcagaatgtggatttttgtgggggcaggggtaccattaagcacacagatcccacctttcaaaacagctccagctgctgcttatccctaatatttattttcgaaaagtaatagtgtactgtcatatatttttgtttacatgtttggaatgtctattttgtcccctttttaagagcaaaagattctcattttagcccttggtacaattcatatatttagtgttatatataaaattttgttttttaattaaacacagttcctggcactttgaaatgtgctaattagatctatccttttctttcctctgtgtttaaagtcaaggctgaatacttgactaggagtgttttgagagtggaagaaaaacataggtaacacagagggcaaggcaggggctgctgaagtagttatatctagggattccctttagagtgtgtctgtgggacttgtcatggagtgaatcagccaccatgcccagtgattatgaaaaggtgaatttatgacctgcctactgatgatagaaattgttgacagtggtctttctgtatagagataacttagaaatattacaacattgtacttaaatcatctttcaggtctttcttggctgctgattttctttcttcatgtaatctatttttgttttcataccttctctattaagacaacaatcaggtgagaaagaggaggagaaacagcatagtgatcagttaggggttgtcatggtggtagagtcactgcctccttaggaggtaatatagtgccaagtcaaggagcgtagactccagagttatacagtcttggatttgaacctcagctctgcttcttgctagctggctgactttgggcaagtttttgaatctttctgagcttcagttttctaaaatacccacatctcaggaatatgtgaattaaataagatatctacgctgtactgaatatagtatatagctcacaatatgggttaagaatatgggttcttgagtaagactgtctgtgcttagatcccagctctgccacctactagttgtataacctttaacaaattacccaacctctctaccttcgtttcttcagctactatatgggataataataggtttgctgtgatagttaaagaaattaatacacatgtaggataacagtgtctgaccatagaaactgcaaatgttaacactcagtagctaataataaatctcctttaattctgaaatggttccacatgtatataggatataatttcttctactctctcttgttcccatgttctcatggaatttgctgttcttgagcttgaaacagtattaatttccaagtgtcttagtcatattgctcagtgttatgttttcttatgaaatacagaaattccttttaaaattaaaaagtgacatccagtgattaaaagactgaataagaatatttgatcaagaatatggtctgttacagctgttcatagtctaagatagacttggagtttttgtttgaaaatgctttgaaaattgttagtgccattaaatttgtaaggtataaggaagttgttagtaattttaaaagtggtttaagtgcaaattggaacactttcaaaagtatttattccagagagactgggatgaaaataggtgtttcctctggaaatcctgactgagcctattcattgagttctgtaatgatagagccagaagaactcagacagtttcagtaccctccccgccgccatcccatatgattctggctgagaaggatccagaagtgtgacacgtttgttttcattctagccatgtattatgtaggcatataagaaaattatttttctgccaaattttagtttaaatgttagctaaatgacttgtgttggaatgcactcagtagcactttaggagttaaacgcagtggtaaagcagtcgtttttttcccttttcatagataagttgtcacaaattttatttttcatattttttttgaggttcatactcatacacttgtgaaactatatttgcattatttagaactggtggttatcctggatgttacttcttcacaacaaatggcccctacttatttgctttgttactatttcaccacttcgttgaatgtgatttcatgaactggaaatttgtgaaaaatcaggttataggaaataatacacttaattgtaagaatttcaaatgtactttttcttagagatgaataaaagtagattttagtaaattctttaattcagacttttcgtaatcatatcccatggctttactgctatttatcaagtatttttatacctattcttatttatttcttactttaaccccgtggttgtaagtgttgttcacagttgataggtgaggaaactgaactgaaaactgataaactaatatgatgaaagagtttggacttaagtccaaatcatctgattctaaatctcaaagtcctagcacaccatgcagcctttccacctctccattgttttaatatggtagctattaccagaaagtttgaattgagagaataaacttgtctttagcatcctttaatttttaccttttatctttggttgaggagacaatagcaaaaacaaacaaacaaaaaaaaactgttttgaacaagaccgaatttacattcagattaatgaattttcatctttttttcagcattaaagaattttcgtaaattatacatgatacggtatttgagtcagaataccctcaaagatctgctctaactcctcattttcttgaagggacctgagggctcaatgatcaagccagccagagtttgttctttataggtcctaaactctgccaaatagtttttattaaggttgtgaaatataacaccttttgaatttttcatcttcttcaacttttatgcactttagaattcagcatgaagagaatttgtctcagtgctaggctgaaacgaagtattttattaactggtcagttgttttttttttttccttaaggggcattctggagaagaggaactttcagcttgtaatctagcccttgttacataactagactactagactacataccatatattctcattataactggacatcttttttgagcctgaaatctcagcagatggcaagaaatagttagggattacgtttgggctaacacagtttcgtatgatgaagaatgtggggaaagatctgtccagctctctggcatgctatcctatggatatgttcttgctggagccatgggataaaaattatagaagaatattgttagggccaggaaggaaagagtttcaaagtagagtttgaggccatgggggtatatagctcaggggtagagcatttgacagcaaagtagagcttgatttcttgctttttgattttgctttctgttgtcagaggggcatgtgttctgggggtaatttgtgtgtttattgtgtgcttgcttggtccttctcagcatgaggtttgtgtctctttctacttcccttagtaggttaaaggggacagaccttttttttctctaacagaatttggaggtccatatttccatgactagcctaggaataatacaggcataaagaaaaatattcacttacacaaattccaaacatacaatcataagttaaaagttcataaaataagggataatcagcactttaccagtgaatctttggcaatgtaaaaatttaactttgtagttcctttagctggtgagctctttgttgcatttaaaatggattttgacttataaaaattcagtttaagattttcatgaatcctcctacacgtaaagcacaatgattgtctttctgttcaaagccctagttggttgtcacatggaaatagtagagttcgatatttgcccttggtgtaaatgcctgaatttagtgtgccagaaaattgttattttttggaatttaaaagtatctcttcaacagataagtacaatttagtatgttgataggattatccttcatagattcagtttttcttttcattgggtaagtgatgcgtattctcagtaaactaggctgaaagtttctaagtccagaattgtggttccaataggactctgaagttacagatgtagtattcaagtcatgcaaatgtatgtaaactaaggaagtatggtctataggtaaaacacttggagaaatgatagtcaattacatgaagattttctttccttttctttaagcagccttcaggtttagaagctcaagttagagaaatagtgttttaaccaagaaaatccctttggcaagactcatatcttgacaaaagcatgttggtctgcataccactttgcataaaagatgtgtattgcattaactatggagaagagaagattccagtgtatttcagcctctttgcaggataaagcaaagcaaatcacgtagccatgctgtgtgtctcaaagggctcttgtgtgggtatttcaactagaaaggagattagcattggaagtctgtgatcatgtcatacatttgtaattgaaggtggctgttgaaaataattctttacataactggattctagcagtcttgatgaggtaagtagaatcaataggaaatgatctgtttgtcactgcttagccacaatgccaaaaagcttggtatctgggaatggagactttaaaaagcgtcagcactgggaagtatttgataattcaagtctaagaggcttcttatgaaaagtgcagaaggaatatatgcatgggaatatataccattgaatttttgccgataacattgtttctcgccacagttaaaattgaaactttgatcactctagtagccacaggtcatttgatgatttttgccaaaccgtaaacttaggcaacttaagtacctgcctcatgtaaacggtcttatatgtgagcatgtttttcctgttatttgtatttctattccttgacataaagttttagaactttttgggggaagttcatgaacactcatagctctttctggtagatgaacatgactcttacttctgtggataaattataaatgtactataaaaattcatctggagtggcaagtgaaaaagatacagtatgatttgctgccaagaacatcttattacatctgcatatttatgctgctaatgaacggatactgctaacaagtcagtttccgaagatacgcagctttggcgaaacaacaaagtgaacaggaaatgtttttcttagaggattttatttgctcatccaaagcaatagaaaaacgttaaatgattggtggtagattttattttcctggagcaccttgtacagcctgcaattcagtcggttattgtgctaagggatgggtgcactgaccttgtcaaaagagggagcaaggatttcgtttgactttggtttgttggttcgcaatactcatggatatctggatctctaaccttggctttttataactataatcctaggcagtcattcactatgaaaacacttgtgcttctctttttttctttgtatttgttcatttgaaaagcctttcaaaaaggagttgcagcctgcatgtgattatagctatcagtagcacttaacctaactgctgagatgaaacttttctttttggaacctgctaattttacatatcaatagaaaaaaaatttcttgtactgttaaaaggcccgactttactaattggtagctactctttggattgagctagaatccttagggacagaatttgatagaataatttttgacattttaatttgacaagaaacaattcagggaaacgattttagtcttgggcctgaagtggagtcttctcttgctgtttgtgatacttagtgtggggaatgcctttgaaacagcactttataaaccctgtgatccatttaatgtgatagttcaagctgcttggctgtttttttcataggagcctcacctaaaatagtctaacacagtggaaagatttttctgtattttagagggtaatgcagtaaattctaatctttgtgagaaaaacatagctttccagaaggacaataaatttaggtgtaaaatgtgtgaattgtatgctcctttatcctttaattgtattatagtctacatctttctaactcaaaaagtactctttgttttaaaaatatcccttcccacacttgaaaatggtagaataagactaattttagttacaggttctttgtgtgtttgtgtgtatatctctatataacagaaaacttacatttttaaataatgaagttaaagctttaaacaagtagagtatatacacacataaacatgcgtgctaatttgtttctgaaaaattatcttagaaatctgtgtttctccaagtatttggggggatatttaaatagccaaactagaaatgaaataggtgtttgaaaaaatatctagctgggcatggtggctcacatctgtaatcccaacattttgggaggccaaggtgagaggatcacttgagctcaggagtttgagaccagcctgggcaacgtagtgagaccttgtctctactgaatatttaaaaattagatggacatggtggcacacgcctgtaatcccagctactcaggaggctgagatgggaggatcacttgagcccaagaatacaaggctatagtgagctgagactgcgccactgcactccagcctgggcagcagagtgagaccctgtcttaaaagagaaaaaggaaaaagaaaaatatctggagacaaacctggtttctaagcctggggagtagattggaagaaagggaaaatatgacctttagtttcttctttgcgtgtgtgtgtgtgtgtgtgtgtgtgtgtgtgtgtgtgtgtgtgtgtgttttgagacggagtcttgctgtgtcctccaggctggagtgcagtggtgcaatctctgctcactgccagctccgcctcctgggttcacgccattctcctgcctcagcctcccgtgtagctgggactgcaggcgcccaccaccgcgcccggctaattttttgtatttttagtagagatggggtttcactgtgttagccaggatggtctcgatctcctgacctcatgatccgcccgcctcggcctctcaaagtgctgggattacaggcgtgagccaccatgccctgccttgtgtgtgtgtttctaatacgtaaaattttgttttttactaggtaaggttagaaactgatactctcaaatttgctcataatagtgacttattctagatgaggaaaatgcattgattttattaacaatatatccctcggagattagggtaggtagatgatttggagaagtaggttgcttgatatcaattagttatgttgcttcagaacaagccattattagtttgtatcgtaagtactttagtgaaagaaaaaattttaatggatttggtggtcatgtcaatttgtgtactagcatgtattctctttctctgcacctccctgcccccacctcccaactcaccgtgccctgcaaacatttttctgtctgctttttttctttctcttccttttttcttctctcatttaaacatagggaaaattgtctaagaatgcctgtgactgtaaataattcgtttcatgaagacttatgactttaatcatttttacatttattttagtaaaaatcatttattatctttagcaattcactgggtaaaattgctcataaagaagaaatatcactattctattttcctctaagaaaaaaagttctaagaataaaaaagtcaaagttaagtcaacatagcatatcacacattgagtttgtattctaacatacttttgtttttgtttttttaacttttaactgaaaataatgctggaatatgactccatgtgtgtgatatactacaataatattagagatactaatttcacatgtagttgtcctaattttgagttggaaaacttaacaggaaaaattcactggagtcctgtcatataaaagactatatttttaggacaacatcaagtcctttaaaatttattttggaatggaggctttatgcttaaaataaacttaggggaaataaaataattttaaaagtttcttcagccattgtgtatagtttctgttagaggtaatttccagcaccggaaaatcaggaagtctgtagtttaaattcttcagtatgagattatattgccagttttctttacacatggtgttcagtatgtattaagtgacagctgtaacttttcttttcctcttttacctttgggaatttcaagaacacagctttagctttcttctaatttgtgttattttttatatttaaaaacaattttcaagaatatatacatttaaattatagtgtgactgaatagctgaacaaccttctaaatttgtttagcatattgtgttttaaaaattatgtaaatatctatcggtcaggctttaagaacttgtgtcaggggacagtaagaagggatgggagaaatgtcattccttttaggtaagattagaccaggttatgttcatttatttatttatttattttggttctttttttctgccacttatgaattcatctgagcattgagaattgttaagataaaatgtatttgccaaaaattaggcccaacaattaagtttgaaaattgccagggatatcaaaagagattttagacgattttcatggctttaagggagaattgactgaatatggattattattattattattttgtttgtttttgttttttgttttttttgagacggagttttgttcttgttgcccaggttcgagtacagtggcacgatctcagctcactgtacctccacctcttgggttcaagcaattctcctgcctcagcctcttgagtagctgggattataggtgcccgccaccatgccgggctaattttttgtatttttagtagaaatggggtttcatcatgttggccaggctggtcttgaactccggacctcaggtgatccacacccgcctcagcctcccaaagtacaaggattacagacgtgagccgccgcgcccagcctaatatggattatttttaagtttcagagaatgttctgtgattttgataagcatagtcttttgtgatttggcttaatcaaagaggttgaaatgagagtcattagccaagtgacatttaagtgccttggtttgtctgcttgcttttctgtggattgaaaaaaactgaccactgttaatatgattgtacagtgacactggaaattatgagatgtgtgtctggttagtcctgcttgtatttcagttgagatacataccaagtctgataatgcagagcttttccatttcatgtgtctgtttaccattttcatgatcttaagcaataaacatttcttgacaacagcatcagacctcgtttttaccaacactcattctttactatacgccaaacatgagcacaaattggtttttatccatattaatgaaaaacaaaaccctctatttcagtctataacacagatacatgagatgctaggaagtctggaatcaattaagtcagccaagtgtgtgggaaaaaagacagcagacatggaaatcatatcaaaatgacttgttttaaagaactggaaacctgcagactaaatggtgaataagaaattaatttagaaaacactatttaatatgcactatttaatttacatttgatttttaaactgtagaacatacgtgtgagagtactcttggtcttcaaatgactatgggtctgtattaattggtgtttttatccttttcatgctgtatattttaattggtcttagaagaagatctgaaaatacaaagatgagaaattacttgagcatagagtttaagaatagtacttgctagctgatgacaaggcaagataatataggctcccctgggctgatttagtgtgaaataggcacaagtgtatggcaaataaatgtcagtggggaataaaaaatgtcattagggagtaaaaaagctggaggaaactccagcttctctgtgagagaattagaagatcatacctgttctagatacttccaaaggcctttctgttggcactgttttatgttaaagtattactaagttaaatacaagtaaagtcctggctcctgcttgtgctttatcttgtgccataagagaggaactgaggtggttttgaagtatgaatctttgtcccagtgatccctttgtgtattccaatagagaataaaaacctaaatgagaacaaatttgctttttccatggatggattgtattattaatcatatactgctcatctgagtgaaccctagtttgtttgatttctgatgtatctaaccagatggcttgacagtaaatactcctccctaaacaaatcactgatttgtatgcttcttcagcatctcctgctttgaatattccttaaacattattactctttcttagactcaggtctgaggagcaacaaagtatactatcatgccaattgtgttaacctctggagacaaaaatgataattgactgacattcacaaacaacttttaaaagcctccaaagctttcttattattgggaaaaccagtgaaaagatgactgggaggagggattaggcagaggatatctaaatagaaagaagtctgacctaacagtccagagatcaggtttttcctaagtcatggttttagattattttggtctgattatttaactctttgggtctctcttcctccaaatatggggagcttacttatgatcctaacttcctgataaagctgtaaatattaaaatgggtttgagttaatagatcctaaaacactttcaggaagctcttaagtattgtgcaaatgcaggagattcatcttatttactttagaataactgaaaaggatcttgagaaaattatactcatttgtagacttaacaaagaatttggtggccattttcttctctgcatagaaggagccagtttgaccaaattatacacacaggatacggacaggtgccattgtgctcagctattttcccttatgtgagagccttgagttggatgtttctctgggcagctaatccttggcaccacagctttgttctgatagtggcatctggcactagattgatttaactgagcctgaggtttgctcttttcagaatgtgctctctaggcagcttctttgtggctctgacatgaccacatgctgctgctgctttttctgccttcttgctccacatgtgaggctaagacattctgacacctgccatttggaacctttacttgctgaaaaatgtcaagattttcagacaagatgaagacagatataactgattttttcctttctcaggaagaggctgagggcatttgttcatagatggatgagttgctgaagtggtacagttcatttatttttgagagtgcaccacaggttttgtgtagaagactcggttgtgtttatgtgtccttattctcctttgcacctatttggtgtgatactaatttgatctttgtagaagtaaaggttttagtgattattttctggacttcactagataataatgagggttggcggtgtgttcccatccttactcctcgtttttattaaagacttcacgaggaaattgcagatttttgaggatgggcttctgttacgatcatatgtcatacatatgtacacactggtgaccatcaaatctaaaagggccaggcgtaagacctcctgtttaaggtccttgccgcttcctcttcccttttccccctcgagccatctaaatgtcctaagtctagaggactgattagtaataaaggacagaaaaagtgtttacttgataagtgataagtttttgccttctagtaattgatagctacctgtttaaggaaggaaattggtgaaaaaggaaggcttaaaaaactattattattttgcatattattaccttttaatattatggttaaattataattggctgtatgctttgagtaaactatttcctctgtttctcgtatgttgatctttatcttgaatctctggtctgattacatcacagagatgatgatagtctaatttggtgtaatttgggaaagaagctccaatgactctaatctttttgaattgcaaaaaacataaagaatttggatgaaaaaatgccctaaaagtcatttttttgggaaccagactgtgttgaaagtttgtgggtcagatatgaagctacatcctctggcatcactttggaaagctttttctcaagtggctttaagtggcacgtggaaaagggagaatgaaggattggccaacaggcttgtaacttatagggtaatttgtgaagactagtagataatttatgaagactagtagatatgtaaaatccatcttgagcaattagaaggcaatgaggactaatggcttttatgttatcaataagatccatgaattggaacataaatatttgaaaatattttatagtaaaaacttggtagttcttcagtaaagaaagcttcttgcttagggctttatataactcaagactgacttgagttatataaagaaggattcttgttgcaaatttaaactttctttatcttttaactggattctgcctattataacagtttttccatagaattacagaatatatgtcttaggttatagaaatagcattcatataagcctcctcctctttggatttgctttttggaagtgggtaatcactaaggaaaaaccatgcattattttgggtttcaccttggaaatgaataaccttaatattactttgatctgaatcaaacatattttacatttgttgaagtatgtttcacacagttgctaattatggtattagacaagatttgaactttagctgccgtctttggttcctcttaatttgaagtacaatagattttcaactaagaaagggatgaattggtatgtgaattattttaaatggctctaaagtgaaaatgactaataaaattagacaaaaatgccaagataaatcaaatgtatttttaagataatatgcttgttctctataatctttaccatggtgcaccatttatcttattaatttgtaaagtagacatgtttcttatatttttcataagtaggatgtcaaaagccatagggctgaccaatgattatgaaaacactggcgcagcaatccatattctttagtatgaacactccatccagtcttcctaggtgatagctcaggcccatctgaagctgaaataaatgaaaataaatttatttattccataatatattaaagtcagttgcaagttttcttcatggaaagggctaattaatatgtttaggatgccagttatgataggctttgctaaaacaaaacagaaaagtagatgctatgaaagacatttatgtattgtgcagctggaaaactcttaagctttcacatagttcaagggcttggtatttcttttgagtttttgaggctttagaacagtgattctcgtgattctcagagtgtgggcctagacttcatcaaaattaaaaacttttgctgggcgcagtggcttatgcctgtcatcccagcactttggcaggccaaggcaagaatattgcttgagccctggagtttggggctgcattgagctgtgatcatgccactgtactccagcatgggtgacagagtgatatctttttttttttaatttattatactttaagttctagggtacatgtccacaatgtgcaggtttgttacatatgtatacacgtgccatgttggtgtgctgcaccacttaactcatcatttacattaggtatatcctaatgctatccctcccccttccccccaccccacgacaggccccggtgtgtgatgttctccttcccgtgtccaagtgttctcattgttcaattcccacctatgagtgagaacatgcggtgtatggttttctgtccctgcgatagtttgctgagaatgatggtttccaacttcatccatgtccctacaaaggacatgaactggtccttttttatggctgcatagtattccatggtgtatatgtgccacattttcttaatccattctatcattgatggacatttgggttggttccaagtctttgctattgtgaatagtgctgtattaaacatacatgtgcatgtgtctttatagcagcatgatttataatcctttgggtatctacccagtaatgggatggctgggtcaaatcaaatggtgtttctacttctagatccttgaggaatcaccacactgtctttttgttagttttccttttaacagtcaggacccttagctgcaggtctgttggagtttgctggaggtccactccagaccctgtttgcctgggtatcagcagcagaggctgcagaacagccaatattgctgaacagcaaatgttgctgcctgattgttcctctggaagcttcgtcttggaggggtacccggccgtgtgaggtgtcagtctgcccctactggggggtgcctcccagttaggctactcggaggtcagggacccacttgaggaggcagtctgtccgttctcagatctcaaactccatactgggagaaccactactctcttcaaagctgtcagacagggacatttgagtctgcagaggtttctgctgtcttttgtttggctgtgccctgcccccagaggtggagtctacagaggcaggcaggcctccttgagctgcggtggactccacccagttcgagcttcccagctgctttgtttacctactccagcctcagcaatggcaggtgcccctaccccagccttgctgccgctttgcagttcgatctcagactgctgtgctaccaatgagcaaggctctgtgggtgtgggaccctccgagccaggcgtgggatataatctcctggtgtgccgtttgctaagaccattggaaaagcacggtgttagggtgggagtgactcgattttccaggtgccatctgtcacagcttcccttggctaggaaagggaattccttgactccttgcgcttcctgggtgaggcgatgccttgccctgcttcacctcacgcttggtgggctgcacccactgtccgacaagccccagtgagatgaacccagtacctcagttggaaatgcagaaatcacccgtgttctgtgtcgctcacgcagggagctgtagactggagctgttcctatttggccatcttggaaccacctcccctccagagtgatatcttgtctaaaaaatattttaaattaaaaatcaaaaaatttttttaaaattaaaagttttgtgtttcaagtgagattcatcccaagtatgcaaggatggttcaacttatgcagatcagtaaatgtgatacatcacatcaacagaatcaaggacaaaaaccatatgatcatttcaatagatgctgaaaaagcattcagtaaaatccagtgtcccttcatgatgaaaactctcaacaaattgggtggagaaggaacatacctcaacacaataaagtctgtatatgacaaacccatagctaatacactgaatggggaaaaactgaaagcctttctactaagatacagaacaagacaagtatgcctactttcccacttctatccaacatagacctagccagagcatttaggcaagagaaatatataaagagcatccaaattagaaaagaagaagtcatattatccttgtttacagacaacaccatcttatattttcaaaacctaaagactccaccaaaaaactcttagaagtgataaatgaattcagtaaagttgcagaatacaaaatcaacatatgaaaatcaatactgttggctggctgtggtggctcacacctgtaatcccagcactttgggaggccgaaacgggcggattgcttgagcgcatgagttcaagaccagcctgggcaacatggtgaaaccccatgtctacaaaaaaattagctgggcatgatggcatgtgcttatagtcccagctacttgggaggccaaggtgggaggacagcttgagtgtgggaggtggaggttgtagtgagccgtgattgtgccactgcactccagcctgggcaatagagccagaccttgtcttaaaaaaaaaaaaatcaatattgtttatatatactagcagcaatctggaaaagaaatcgagaaagcagtctcatttataatagctacacacacacatatacacaccatacacacagaataaatttaaccaaacacacacatacacacacacacacacacacagagacatgcacagaataaatttaaccaaacacacacacacacacacacacaggataaatttaatcaaagaagtcaaagatttttccaaagaaaactataaaatactggtgaaagaaattaaagaggatggaaagttggaataatattccatgctcctagattgggaggattaatattgttaaaatgtctttactacccaaagtgatctacagattcagtgcaatacctatcaaaataccaatgacattcttcatagaagtagaaaaaaaatactaaaaattcaaatgaaacaacaaaagaccccaaatagctaatgcaatccttagcaaaacgaacaaagctgaaggcatcacactacctgatttcaaagtatactacaaagctgttataaccaaaacagcatgatactggcataaaaacagacacatagaccaatggaacagaagagagaacccagaagtagatctgtacacgtggagtcaactcattttgacagtggtgccaagaacacacactggggaaaggacagcctctttaataaatgatgctgggaaaactggatatccatttgcagaagaatgaaactagatccccgttttttaccatatataaaaattaactaaaaatggattaaagacttaaatgtaagacctgaaactataaaactgctaaaagaaaacattgggggaaatgctgccgatcagtggtctgggcaaagatttttggggtaagacctcaaaagcacagacaaagcaaaaatagacaaatgggattacatcaagctaaaaagcttctgcacagcaaaggaaacagtcaacaaagtgaagaagcaacctactgaatgggagaaattatttgcaaactatcacaaagggattaataactagaacatataaggaagtgaaacagctcaatagcaaaagaaaacccacaaatactgtgattaagaaatagtcaaaagacctgtacaaacatttctcagaagaagacatacagataaccactagatatattaaagaaatgctaagcatcactaatcatcaaagaaatgaaaattaaaaccacaatgagatgtcatttcaccacagttagaatgacttatcaaaaaggtaaaaaataacaaatgctggagagaatgtggagaaatgtgaacactcatacactgttggtgggaaggtaaggtagtatagccattgtggaaaattctatatgggttccctaaaaaaaactaaaaatagaactgccatataagtcagcaatcccactgctaagtatatatccaaaagaaaggaactcagtatattgaagaggtatcgtactcccatgtttattgcaacactattcacattagccaagatatggaatcaatctaagtgtctgtcagctgatgaatggataaagaaaatgtggtatgtatacacaatgggatattattcaaccataaaaaaagaatgaaaccctgtcatttgcagcagcctggatggaactggaggccattatgctaactgaaataagccaggcatggaaagacaaatattgcatgttctcactcatatgggagacaaaaaagttgacctcatggagacagagagtagaatggtagttaccagagttggggggcatgaagaagttatatagaaggaataagttctagtattccgtagtacagtggggaaattataattaacagtaatttattatatatttttaaatagaagagaattgtaatgttctcaacatgaagaaaaatagatgtttgaggtgacagatatcccacttataccctgatttgatcattacagattatatacagatatcaaattatcaatgtaccccaaaaatatgtataacagttatatatcaagtaattttcaaaaattaaaatgagcacacacaactttctgtttcagaaaaccattaagagaatgacaagataaaccaaaattgggagaaaataattgcaaatattgtatctgataaaagacttgcagttagaatacgtaaagaacagttatgactcactagtaaggagacaaaccaattaaaaatgggcagaatagatatttcactaaagaaggttagaaaaggccaataagtacattgagtaaatggtttacatcattaatgattaaagaaatataaataaaattataagtagataacacttcatagccactaaaatagctatagtaaaaagagagacaaatagtaagtattgtcaaggatatgaacaaactggagccttcattcattgcacctaggtagttttcttttttgagacggaatctcactctgtcgcccaggctggggtgctgtggtgcgatctcaagcgattctcctgcctcagcctcctgagtagctgggattacaggtgcatgtcaccatgccgggctgattttgtatttttagtagagacagggtttcaccgtgttggtcaggctggtcttgaactcctgacctcgtgatctgcccacctcagcctcccaaagtgctgagattacaggcgtgagccaccacgcctggctggcagtttcttaaaaaaaaaaattatatgaaattgaattttggtgatggttgtacaacatttactaaaagtcattgaattatattcacttaacatgggtgaattttatgcaatgtaaatcatacctcagcaaaccttaaaaagtgtgggcccgggaccagaagtatctgattcaccagagaacttcttagaaatgcaaattctcagccacagtgaagtagaaactgtgggggtgtggctcagcaatctgttttatgaaaccctccagctaattctgatgtaggctccagtttgagaattactgctctagattgaaggaaagttaaatggaaatgtgggttgtttttggtaccgtttatgtacattcagtctaccctgttcctgtaactgcaggaagggtttgaattaaggactgttctagtagaattaaaggaaattatagggcaatgacagtaaaaataaactggcctttcatgttcttggtatgtccccatgagaagctctatgattgtgatgtttgtgtaccacatgttagtaaattcctgtgttcttttaggcttgccattaatgaacatagcataaacaggttcatttgccatagcgacagtagaagtttagatccttgaaaggaattatgtctcctaaatatttacacagtgtaatatagcagagtcagaaatgtgcagtgatcacaaaaaagtaaagatctgactctagattaagaagcagccggctgaactgagcaactcattctttccctccatctgttcagtgtactttaaaaactatgattagaaaagaggctgatctgtacatagcatgtgttttcaggattttttttcagcattagctgggtggccaacagaaattttgaaggttgaggctgctccagaatagatcttcaagatccaaactggaggctactgggtggtgagtatgttagatgaagtttgtagatagggtctcctttgactggatagtggtgactcctgctgaggtataagttcagaggaaagtagaggttgtggggagagagataaacaaatgtaagagaagggagagagggaggagtgaggaatggcatcatgaatgtatgtcatttgttagtggagttcgctgagattgtaacagtacagtatagaagcatattagtgaatgtagcagaaaccattgttatttccaaaactttattcagctataggtaaaaaagaactgggctgtttgttgccggcaaagtatatcgctgcttctatctttctctttttaattattattattattttactttttactgttgtttcattttgctttttttctgtttgtttatttggggttttcttttttgttgtcattcttttttaatgcttttaatagtcagtattattgggaaaatatagcaaaatattagaatattctcaaagttggctaattctgtcttacgttattagataatgatggagtagaataatttgcaatatgttttattctaaaaaatctatgccatagcaatctgaacttctcatatttattactggacaaactcccacagatgcatttaagctaaaaataaaaacaaaacaaaacataggagcagtggaagagtaaatgatgcaaaatgatgcaaacttttccctttgttaagcaaacttcacaattctctgtgcagctctcagatttgtatctgaatgaaggtgcacttgaaaagtataaacaaatacagataatctggtattatatgagtaaatacaaatttgagtacaaaagacataaataattttggagttaagtgcaagaatcaggagaagcaacttttgggtgctttgtggggatggcaggtgggttgacataccatgttttttaagccaatacatttcaaaatgttgaccaaagaccattttaattataaaattagaatagtgtttattccctgcccccttaggttttgtatcttgttagcagtgaacctggaatgtttatagtactgttgcaaacaacggtttcttccacagttagtgttccttcctctctatgagcctgcttttcctgtcccagtatcaaccaggcccttgcctcttgcctagtcgaatgccacttacgcatcaggtcttgtgtttggtcctgtggcagtttttttctttagtttccttagtggtaccattaaatactttatggtatggcaacaactttatgttggtatcagatacaggtagagaaaaaagataaaagagggattttgaaagagaaaagcagaatgcggggagagagggaagagagagagagagtgagatgcttactgtggaaggtaaggggaaacaatttctgcttacgccattctttgttgaaatttcttctacctcagtagaggtacttaatctacaaataggaaacaaactttccatcttttttgtccttcagtttgttgatttgcttttccccatgatggcatttgaaggtaccattgagtttgtcatctctgtgaagtttggaaccccaaaatccaaattaaagctctgctttttagttggtaattcgggtctgtccattttaggtttattttgtggttggaaagtgttcttttcatccactgtggtatggggcaccaaaagagaagtagccaagataattctgttcttttgaaagactgctctgtagctaagatttgataggatgtccatcctggagtatacttagatcctctggttggtagactttttattttctcccaggcttggtgtggatcctctgtgtgataactgtaccactactagagttgttctctgtggaaaatgatcatcttttttgaaacataacaaacttaaaaaaacaaaaacaaaacgctggtaattgaagaattgcttctaacttgtcctccaccagatggtgctagtgttacgtatctaaaggtaaactcctttggtattgaagtaaggaggttgtgtattttctttctctttttctgcctcaccatattttgcccttagtactttttcatacatgctactttcctggcatactgctgcatcacttcacatattttatattgtagatagtgagctggttatgccttagtgatcatgaaggataacttgggaggccaagtaaaattcaagagggcaaggaccaagtgaaatttaaggatgtataatttgtattttcttataagatttttttaatcattcatttgcttcttaaatggcctgtgtgtaaaagttgagaacttattcttgacttttctgcttagctatctttcttttatgttatcataatgatgtcataaaatgtcattgcttgagatcttctacaaacaaatgatgtatttaccaagatttaagttcacaataactttaaaagaaagcttggtaaattaaaaaaaaaaagttggccattatctgatatgattccctgaccaattaataattgttcttacatttttaaaccttttctgattacatatgagtattacatggttattgcagaaaaacttaaacaagaatacaattaaagtaataatacatgtttaaatactattaacattatattacataagcctgctttttctttacccagttttaacttaataatttatcataaatattttacatgagataaaaatattttacaataataattcttaatgaaagcttaattaaatgaacactgtaatgataggcatttttttccactttgtttcagtcacagttgtgctatcataaatagtgcagtttaatttttttgaatttttacatttcatttgcatgtattgctaaaaatataatagctagttcagagagaatgtacatttttgtgatttttgatctgattttcaatttaccatccaaagagttctgcagtttgaaagtctttgacgggacatgattctgcttgtttccgtatgtcctcttaatcactagattacctaatttattttatttttttttttttttgagttgaagtttcattcttgttgcccaggatggagtgcagtggcgcgatcttggctcactacaaccttcaccttccagattcaaacgattctgcctcagcctcctgagtagctgggattacaggcatgtaccaccacgcttggctgattttttttttgtatttagtagagactgggattcaccatgttagtcaggctggtcttgaactcctgacctcaggtgatccacccacctgggcctcccaaagtgctgggattacaggtgtgtgccaccgtgcctggccttacctaagtttttaagatgactagatattgctcatttgagaatccttgaaatgataattcatcattacataaaagaatttaaaattgctttgatattttcttagaagtaagctctaccctttaagcattaaatctcagagcccccactgttcgtggtagtttagtttttggccttgtctcctatccctaaaatacaaacagctattcttttgatacttcagaacaggttatctcatatgcaaataattaagatttatgttggttcatgtttttagtgctttgtattactcgttgagaaacctagtgcaagtcatttaacctctcacgatatgtttctcagtctgacaagttggaagaatgttttttagataaattatttttaaaactttgagatgagctaggcatttggcatagtggctttttaataccttcatttttgataggcagaaggaaggaaaaggggaagatgctagatatttgtagagcctgaagaattctaatatacttttgtaaagaattaaaaaggtatcagtcagtgttgagtaattatatcccagttgatttttggtatcttactaaataactgcatttttatttaagcaaattacttttaaattaagttcttctgttaacataaaagagcatgtaatttattttaaaatcagaaaaaccaagttattttcatatttgggaaatgggaagaaaagagattcatgcagagtcttcatgaaatcttgtaaatgaaggtgaaaactgttagcccagtaatttaaaaaaaaaaatagttttggctgggcgcagtggcttgcgcctgtaatcccagcactttgggaggccgaggcaggcggatcacgaggtcaggagatcgagaccatcgtggctaacatggtgaaaccccgtctctactacaaaatacaaaaaattagccaggtgtggtggcgggcgcctgtagtcccagctacttgggaggctgaggcaggagaatggtgtgaacccgggaggtggagcttgcagtgagcggagatggcgccactgcactccagcctgggcgacagaacgagactctgtctcaaaaacaacaacaacaacagaaaaaacctagtttttctttctcatgaaaataatctcaccttcccatctcaatttggcaaaatataataatgataataacattccttatggtcagaatgaatagtcactgtaagaaaagttttttgaaaacctagttttaaacggttcatcaacatacaatctgtcatggtagaaaagacttgtaaactgtagagatatcaattctgttatttaaacgtatatcttttatacagaaaacaaattatattgattaatgattagctttttgtaagtaacaccattgaattttacctaagataaaacttagcatttttgtactgggcgtagtggctcacgcctgtgatcccagccctttgggaggctgaggcaggtggatcacccgaggttgggagttctgatcagcctgaccaacacggcaaaaccccgtctctattaaaaatacaaaaattagctgggcatgatggtgggcacctataatcctagctactcgggaggctgaggcaggagaatctcttgaacctgggaggcggaggtaatagtgagccgagattgcgccattgcattccagcctgggcgacagagtgagactctgtctcaaaaaaataaattaattaaataaagcagcatttttaactcaatagggtttttgttaaaaaatttgaaagtgaatgcgttgatattgtaggtactttacttgctttttactttataagtgtgtggtttgtttccttaaaataaaaatcctaaaaatagtgcttaaataaaatatcttaaattatcaatttaattatagagaattggcatattaacttttagatctggtaaaatgtaaattcaatgctagcttctgaagtgtactttcttatatctaaagcttgaaatactaatgtattggtttaggtgaaggtctaaactatagcaatttgaagggccttctgagtactgtaataatctataaataattagttgaattacaactgtggcagttaaaatccccccagatgataaattctgctcagtcatctgcttcatggcaaaatacataaaataatcaaattgctaggattttgaggctaatttgtttgtactgctgagaaatttgttttgtgaaatgtaatattaaatcgttagatatatgaattttatataaagttcatttttgctttcttcaaaatatattagagataattggaataatttcccaatagtttattggaaaatttcccatcaaacagaaagtgttttcgtaaatttagtgtacttttggcaagtgtctattcttgaactcttaaataggaatgaaaaagggagggtattaaaacttttgttcttagcaatgtctggaaaaaaatcatcactcccagtttgatttgtttcattaattctagtcacatatacttcttcagtccttacatgttttatattgaagtaatcaatgttgaggtttttctgtgcatttaggttatttaagatttctgatctatgctgagcactgaactgtgtattagacacatactcttcagtaagtaaagcatatgaaatttactacattttgtattgatttaatattaatgttaatccacaatctttgggtgcaatgtgtcacatctgttttgtattcctctgtttaaaagaaatggcagtatggtatttggaggaatatttattatctgagtgtttttctttgcaatagtttccctcagtctattgaaaattataacctccaaaagcccagcaaattctcaggtacccagttgctaacaaccacagttaattggaatttttatttaccatttaagttccttttatttaaatagttgtaactttggaggcttctggaaatgatagaaaataaatctgtggtgagatttacaaaaatattcttttctcttaataataggtctagcctgtacttcatggatactctgtctttttagaaaagactttgttagattgaatgttgatttgtatttaaaaatgaattttccataggtggtggctaaatattcttatcctgtagtagtgtttcttaacctttttgggggtcacgaatttaagtaatcaatgaatgctagaaccagctttccttgggggaaaatttatataaacacaaacattttacatgcagttctgattaatcctgcctcttcctgcccaatagtccaagggcccctggttaggaaatgccactataatggaactgaaaaaatcacttcttaatttagttttaacatcacattattatgtaacactacattttcttcactacaagctttatttaacattacattttctccttgatcattatattattagaagataagcgtaatgtaaatgttattttggagaaaatgcagtattaccttttaattttgaagctggtctctgaagttatggaacgtatttgactcctgtatgtcctcaagttctgctttagataagtaaacaattcactttaccttttgatcaaagaaaaaggcaaaggaagagagatacgagttcttctagatcttttgtttgagaaagtagctcttccttagaaaaatatgttgcgttggttgtttggcacaaaaatatgagttctcattttattgagagtttgagaaactatttaagggttacctggttgtgctggttaagggctcagacttggaaatcaagcaggttagggtccaaatctaactcagttcctttccagctatatgatcttgggcatactacttatccccaaaatggaacctactccattaaatgagataatgtctgtaaagtgtttttttgctttgtgtataatatgcactcagctgttattgtatcatgatgatggtgatgatgaaaaacaggataagcagccttgcttttcagttgtagtgtttatttttttctatttaaatttaagagagtagatcttggttgcagaaagagaagttgtcacattccccagaataatcttctcaagttgtggtggcttacatttgtcataaaaatttattcaagaattctccaaagatggggatagcaaactaacttttccacattttacttctcaatgttcagttgttacagtggggcagtacgttacatgtcatccattaaatttgcctcatgcaattgaagtaaatactgaggagcagagaaagggagaggttgctaagagtgaattaaaaagtgagccctaacatgtttctggttttgaatattgacacctacatggtcacatggtatagagccacatgtattgtgtatacttagagtagatgatgtttctttgcctgtcatgtcataaaggagaactctaatgtaaaaatttttcataagctgtacaaaatggcaatccccatacaaatgtcagctgtaagacagtattctcattgtgggttgtatggtatttggagccaaagaagaaaggaagagaatgaaagagaatgatttgtgtgactatttgattaaataaatgatgaaaggaattaacacctgcctgagtggaagactttaagttcactgaaaggatgatgattttcagaccctcctgaaaagaagtcggatgacatcctgtctgatccctttttttttttcatgttgtggttgttaattataaccaggtaataacaataacagtgcttatgatggtggtttttttgtatgtctgcatgtgcacatatccacacatatgtccatatgcttttcaaggtgccttagaatgattcattcaggtaagaatcataaatgtcagtcaataatgaattataaatacaggagaggctatgtgcattctgaatattttgaagttggcatcatgggagagtattcattgtattaatctataaaccatctattgttaccagtgacagagaaagcaactgatttctctgattgaattcattatggatttaagtctgtgtatttcatatgtgaaaaaaacaaacactgcataatcattttatattaatgaaatattagatgctgtcagtatcattgagatatgaagagaacagtttgccctgttatttttttttttctggtaatgcctggtttcattcatttattttctttgaccaggcaggaagttaggaaagtgatattcccctttttctgtcttctcagtatcgtcagtgaagcaggagcatcaatctacagtgtcagccctgaagctaacaaagagatgccagggctggaccctaatttgagaagtgcaggtaagaaactatggaccatcacaaaaacatgtgattttgatattttgggcagcatgtgtggcatgctaaatattctaaatatcaaagaaaatttaaaagttatactacatgcataagaattggcatattagaaagaaagtggttaattggactaataattgaaattatggaaaagaagaggaagaatattgtactttttaaaagaacactactgttctatagtggaaagctaacccacaaagtctttagcaaaattaaatgctagagagttcagtaataaaaataataggccgggtgcggtggctcaaacctgtaatcccagcactttgggaggctgaggcaggtggatcacgaggtcaggagttcaagaccagcctggccaagatggtgaaactccgtctctactaaaaatacaaaaattagttgggcatggtggcaggtgcctgtaatcccagctactcgggaggctgagacagggaattgcttgaacccaggaggcagaggttctagtgagccaagattgtgccactgcactccagcctgggtgacagagcaagactctctcaaataataatactagtaataataatattaataataaaagatcctaagatcttttattattgttacaaaatattattgaagctttttattggcaaaaagtaatacagtaacataaaaatatttgtaatacaaatttatgaaagtacacagactttcagtttattgccaaatatttgtcaaatgaccagtctctcatcttgctaatagagttgtcatttgatcatgttttgcttaaaacagcttgctttgattttagttgtatttgattgctttgatttctataatgtggaagagtcaaaatcttgtgtgtaaagaaattaagatactatgatgcatctaatgaaagcagttggtatcataagcaatatgttagatcaggtcagtgcatttttctgtataataagtgaatatttagaccacttggttagtaatggaccttttatttaattttttccttaaatattctcatcagatttcatcggctgttcttgaaatctatacctggagagatatatatgaaatttttacagtaatctaaagctaaaagcgttcttacgtccaaaagagcttgtagtttccctttagttgtttcatgacataattccctctctaaaatgatcatcttcttaaatctgagctaaaaatcttgcttctcctgggaagctgcttcttagcacagcagctcagcgtgatctctgtctccttaccatgtactcttttggtggttgccttataataataatggcagaaggaatagaaatagtagtcatactgggagctgctaatagtaattttttaagcacttagtatatgtgaaacattgtggtaagtatgttaccaagattattttatcctttctattcccctgtgaggtatttattattatccccactttttaaaatttatttatttatttattttattttattttattttattttttttgagatggggtctcgctgtcacccaggctggagtacagtggtgcgaactcggctcactgcaagctctccctccggggttcatgccattctcttgcctcagcatcccaagtagctgggactacaggcgcctgccaccacgcctggctaatttatttttttgtattttttagtagagacgaggtttcaccatgttaaccaggatggtctcgatctcctgacctcatgatccacccacctcggcctcccaaagtgctgggattacaggcgtgagccaccgcacccagcctatccccacttctaaaataggaaactgaggcttaaaaaggccacatagccagtaaatgtgcacataatatttgtgtacctaatttctatgataaaagggtactttcatttataaaaaaataaaatccagaatttctcaagttgctattgagaaggtatctcccaatagtgtgttggaaaaaatatttagaccatattttctgagaggtaacaatccctcaggcctcccgctgctgaagatactgctgtttcttcttaaccactggcccatgtgtgtaaataattgtcacagtattataggtgagacagaattacaacattccaacaagattctatgaaaatagaagataataaaatggagaatcattctatgattctaattactctaatttcaaagtctagctgtgtcatcagtgtgtgattcattttaagtatctgtgtcttccttctgtgtcttagctcacttctatgtggcaatgaccatgtttaatatatacctagaaactttgagtctttaaaatctggtcctggagtcaaatattcaaagagcttggagtctctactcttggttttccagagtccactttcttttcaattcctatttctcattgggagtctttctttttcctggtgattgatgccaggggtgactttttacgttatgtgagatctgagctacctacgagtgtggattttttacctttaagtcctctaaaagtttgctgtataagaatataacagaacttcaaaatttatatgtgtgttaagcatatgtaagaaaataaccctcattactacatctcactggccagtttatcagcttattgaaaacagaagttgtcttctatatatatgcttatattcccccacaatgcatggtacatggcctctaaattggatggatatagtagatggatgatattaaactgtctattatggatttaaagtggaagattgagtgtatgttttattccttctctccttctgaaattgattaaaatgacatgatagaatgaaagcataaacctactaagataaaacctactaagataaaaggaatgggaaaggagatagcaacaacaacaacaagatttgaagcttaaagcagatagatgagcaataagtcacctagtcaacttgagaacattgaattctaagacagcattgtagaaaatacagaactaacctgggatggatcacgaaacccctataggttcaggaaatggtgccaagtactttggaagtatggtgagagcgttgaggctaggttgaaaatgaaagtattggttgaaagtctgtttaaaaagcaacgagaccaaattaaacataggcccagcaatttcactcctaggcatgtctccagaaaaattgaaaacaggtactcaaccaaaatacttgtacacaagtgcttatagcagcattatttataatagctaaaagttggaaacaactcacatgatgaaagaatgaacaaaatgtggtatagccatacaatagaatatcattcagccgtaaaaagaatgaagtactggtacatgctacaacaccatatgaacctcaaaaatgtcatgccaacataagtaaaagaagccaatcccaaaagactacatattgtatggttatatgaaatgtgcagaacagacaaatctgtagagattgaaaactgactgtaggttgtcagggactggggagagacaggaatggacagtgactgcttaatgggtacaggtttttcttttggcataatgaaaatgttttggaacttgataggagatggtggggcacaatattgcaagtatgctaagtagcactgacttctgtactttaaaatagttaattatatgttatgggaatttcacctcaataaaataacaataacaattaacatccccttccacacaattgaggaactatctttttactacctttgcagaagactggggatttgttctctggagagggttaaacagaaggtttctacgatagagggcacagcttacaaatgagagtggggatgctactgaagtaaagggtagttgagtaaatatttacatgctgttttagagatgttaggaataaacctgtgcagataagaggattctgccaatacaagagacaacattgaagaaacttgggattagaggtaccacaaagaaatggccagagcacccaaagtaagccatagttgacaagccttaccactgggcaaaacacttaaagtcattgttttagcatcctgcccctggtggacagtcagaggtcacctaacatgtaatgaaaacttctactattaatattaaaaacagatgccagaatacactagggaagaaaaaaagctacttggaggaaatagagatgatgaagacagaagaaaaagtttaacattctcagagaaataaaaaaaaaattatttatttggagatatatttacataaagtaaaagtcaccctttttaggtacatcatctatgaattttgaaaagtttatactagttgggtaaccttcagtctacctccattatgtcaggatacagaaaatttttttcagttcaacatctttctcagcttcttgttcaaaaatgtaattattacttagagggtcaggattacagtagatttgcatcgacttctaaaactacattttaataagcattatagtgaaaaaattctaatttagagttgttgactgaaaaagacaacatgggggaattttacttattttcctctgttcctgtctgatgtcaaggagaaggataaaatgagatgaatattggactttaaaaatacagatatctaatattgctagataacaggatgagacaaattttaaagagagtacagttcagtatagtcttttaagcaaataaactgatttgctccagaagctttaggattctagatatttcatagaactgaaaggccaaaacccatgacattctttttattctttggatataagacatattatgagtgaggagaaatgttgctttcaaggctactgcatgtggtcatgcaagttatatactcaatcactttaccataggaagtagctctggttgcatatcttttaggatggtaatctttactcagtctgggatcccttcccaacttttggtgtgtcaaatgtaatttttttctctaatgcttaactttttctattaatatcccatattaattgtcttcctctatacattgacctatgttaccatttaataaattagcatttattaaaaaacctaaaatccctatgtgtactttatgttcttgtttcagtggtctgtctagactaccacaatgcaactctctcaatttctgtggcttataatatgccttgctttaattttttaaaattgcatttttcatagcatttcttttgtgttttgcaaatgaactttaaagccttttaataaatacagttgaccctgtgcacgtgcccacggattcaacagtggattgaaaatatttttaaaaaacaacacagcaataaaagtaatatagatttgaaaatatagtataacaattatttacatagcatttacattgtattaggtattaaatgtaacctataggtgatttaaagtaaatggcagggtatgtgtaggttctatgcaaatggtactccattttatataaaggacttgagcatccgcagattttggtgtctgcaggggtcctggaaccaatcacccaaggatacaggatgactgtacttttaaaagtctatagtatatagagtgaaattctgtgaaatttccactttcatccttgttctgcatgttttatttttattattcatgggtttgtgtgtgtgtgtgtgtgtgtgtgtgtgtgtgtttaacgttgtgaataggtttttctccatgatttgatgtttttattgtttttattacattttaatttcaccatactgtacgtaaaatctctgtaatttattaacttataactacaattatgtaccctttcaccagcatctccccattctctccactccccaactcctgtgttattggttcgatagcatatggtagaagcatcaatttttgtttgtgtgtcttgaaactacccaactaattggaaccttattagttctgttattttttcatttgacttgcttaggttttctaggtagacaatcatcatacataaataatgtcatttcaatatttatatcttccctttttgtcaagttgcatcaactagagttttctgaacaatggtgaatagtagtgatacagcaaactgttgtcattcattatatgtgggcaaaatagtatttggcatacatttggacatactacattttaaaaaataatagcttcattgagatataatttacataacataaaatttacccttttaaagtgtacaagtcagtgttttctagtatagtcagagttgcacaactatcaccaccgtctagttttataacttcatcctaaaaagaaacccatgcccattagcaatcacttcctttactgtcttcactcaccacccaaactcctggcaaacatgaatctactttctctctgtatggattttcctgttctggacagttcatataaatgaaatcatacaatatgtggtctttgtgactggcttctttcacttaagcataatgttttcaagattcaaccatgctgtagcatgtatcagcacttcatttctttttattggcaaataacattctattgtatgggtatacaacattttgtttagtcatcagttgatagattttttttttaacatttttggctactatgaataaggctgctatgaaaattcatgaataagattttatatggacatatgtttccatttctcctgagtgtatgcctgagaataaaaattggggcacatgtaactatgtttaacattttccagaaatctttttgacttctattactttgctgtcctcgtcatttattctctgcctctttcattacttcctccttttcttctctgtctcaaaatgtacacgttccctaagttttgggccataactcttcctctctcttaattctctttatcagcaattcattagactcccttttcctgagctacctccctcttactttcaagaatcttttgtcagcctgatcattctcaacctcgagctctgcattattactgtccactaaataacgcattcttgattatcttgccggcaggaaagtagcaccatctctctctaaagcctggacataggagttataaaaatgtcgcatgacatttttgttttctcagtgcatacaaaagttatgtttatactatagtgtgttaagaatctaatggcattatatctcaaaaaatatgtacacatcttacttagaaaatattgtttaaaatgctaatgatcatctgagccttcagcagttcacagtctttttgctggtggagagtctcgccttgatgttcatggttgctgaccagagtggtggttactaaaggctgagatgtggtggcagtttcttaaaataagacaacaatgaagtagtctgctgtatcaatggactctcctctcacaaaaggtttctctgtagcatgtgatgctgtttggtagccttttacattcagtagaactttatttaaaattgaagtccatattatccattcctgctgctgctgctttatcagtgaaggtttctctgtagcatgtgatgctgtttggtagccttttacattcagtagaactttatttaaaattgaagtccatactatccattcctgctgctgctgctttatcaatgaagtttatgtaatatttgatatcttttatcatttccacaacgttcatagcatcttcaccaggagtagattccatctcaagaaaacactttatttgcttgtccctaagaaagcagctcttcattatgtcaagtttgatcatgagattacagcaattcagtcacatcttcaggctccacttctaattctagttttcttcctatttccacgacatctgaagtgactttctccaccaaaatattgaatccctcaaagtcatccatgagagttgaaatcactgtcctccaaactctggctaatgttgacatttgccctcctcccatgaattatgaatgttattaatagcatctagaatggtaaatccttttccaaagattttcaacgtactttgcccagatcctcagagaaatcaccatctatggcagctatagccttacaaaatgcatttcttaaaaaataagacttgaaagtcaaaattactccttgatacatggtatgcagaatggatgttgttttagtaggcatgaaaacagtattaatcttgtacatctccatcagagctcttggatgacaggtgcattgtcaatgagcactaatattttgaagggaatctttttttctgagcagtaggtctccacagtgagcttaaaatattcagtaaaccatgctataaacatatgtgccatcgtgcaggctttgttgtttcattgatagagcacaagcagagtagatctagcataattcttaagaacccaaggattttcagaatggcaaatgagccttgacttcagcttaaagtcaccagctgcattcccctctaataaaatgagtcaggctgtcttttgaatctttgaagccaggcattgacttctcctctctagctatgaaagtcctaaatagcatcttcttccaagagaaggctattttgtttacattgacaatctgctgtttattgtagccaccttcattatgatcttaactagatcttctggacaacttgctacagcttctacatcagcaattgctgtttcaccttgtacttttatgttaggaagatggcttctttccttaaccctcacaaaccagcctttgctgttttcagacttttcttctgcagtttcctcacctctctcagctttcatggaattgaagagagttaggaccttgctcaggattacactttggcttaagggaatgttgtggctggtttaatcactcagactttctccatatcagcaaaaagctgttttgctttcttatcatttgtgtgtccactggagtcacacttttaatttccttcaagaactcttcctttgcattcacaacttggctaactgacccaagaggcctacctttcagcctttcttggctttcaacatgtcttttgaataagcttcattatttctagcttttgatttaaagtgagagacgtgcgactcttccttttacttgaacacttaagaggccattgtagggttatttattggcctgatttcaataccgttgtgtgtcggggaatagggaggccccaggagagggagggaggggaatagccagttggtggagcagtcaggacacagacatcatttattgattaagtttgttaccttataggtgtggttcgtggtgttctaaagcaattacaatagtgatatcaaagatcattggtcacagattatcataacaaatataattaaattttgaaatatttctgagagttaccaaaatgtaacacagtgaccagaagtgtgcccatgctattggaaaaatggcaccaatagacttgcccaactcagggttgccgcaaatttccaacttggaagaaatgtggtgtctgagaagcacaataaagcaaaatgcaatacaatgaggtatccctgtattcttaaattcttgacttggtttactgttgtgggggtttttgttgttgtttttactcagagtattttggcaatgtatatgtgttgaaaatcattcttattgcattacacatttaaatgttaggctaaagaaataatatttgctttagagaaattcaagtatatctctactttaaatctgtaattataaatgtggttattagaagaaagcatttctcctatcacctgcaatgcttgcactaactaaccttttgtgattgatttctttaaataataaaggtttatgtgaaggccttggaatccccgtctcttctgggagaaaaatagattgtgtaacgccagctcagcgttctctaagcttgctttgcaaggagctattgtcactatatattagatgtagtaataaaggatgtgaaaaagacttgaatgatcatgtgttgaacttgatgttcacagtagataagtagatcttatgtctgattagagaagtggtacaaatcagcgactggagaatctgagagtcacttgcaagagatgacttttgtttccagaccttgaacagcttaacatggaaacaggcataggattttctttgatggtcttaatattttcacttaatgaatttatatttcatctaacctgtatgagaaggtgacactgattagcttccatgtgttttgaaaatggaagcagttcatatatatataaagactcagtgtaaatatgctactggagagggaggctgcctttagaactattcataagagttgtaatagttatcttttttttctagctaaatctatcttataaacgaaattagatgtgaatttttattgatatttggtaaaaaaaaaaaggacaataaatgacgaacaagtaaaatcatgacacagttaaaggaatgtttgaaattaactctaaagtttcttgagcatggattgtaatggtcaagaaagggatgtaattagaactatggtgtgttaagagacaagcagttgggacagaaggaggatcacttgccagggcaatcttgcagtcatattcaaggccacatgagtatattcattagccaagtaacttgatctctggttgcattaagatatgattctgctgggcgcagtagctcatgcctctaatcccaacactttggaggggtgaggcaagaggattgcttgagcccaggagttcaaagctgcagtgaactgagatggcaccactgcactctatccagggtaacagagtgagaccctatctctaaaaaaaaggaactttaaaaaaggaggtaattccgtcacttgttcattatttgggggatcgagttctaataagcatatttgacatataaatatatttgtaataatgcagaattatttaaaacaaggttttgcttcctctgtgaagcatgaggtatcctattatgctttacgtaaagaatgaagaatgaataggtaatcatgtaagtatagggagtaaacgttttatttgtttttccaaatctataatcctgtcaaactactttgtgttcaagaatgcctaggagttctgatgacataattcatgaaattttgcatttactttttgtgtggggaaaaaagagaactttgaaatttaaattgttggccttttttagagggatgatgaggagggacaggattaagtacttacattatgagaaactaatgtaagtaattattaggtactgcttttcacattaagtcatacttgttttctgattctgttttttcagtttccatagcaaggcgtgtacaagatccattagctgagctagtgaaaattgagccaaagcacattggagttggaatgtatcaggtaaagctatgtggatcatttaatttatgaaatccatcaatacaaggagcagtactcaaacctgggatagtaattaagtgtctgtgggagtagattcccattttcaaggttatacagtttgtggaaagtaggagttttaagtcatcagggaaggagggaattatttttgtcattgttgttctcgtgttaatgattttgattaagacttagaattgactgtggtcagattgaaagactatgaaaacactagatgaaactaataactaatttggagagagagcctcttcttttaacattattataaaaatggtggtgctatctaaaataattacaatagtgatatcatgcattgaacttgatcttcacagtagataagtagatcttatgtgtgattagagaagtggtaggtaataatagtactcgtttttgttgttactgtatttttaattcttgaggttgtatgtgttcattgggcaattcaagacagcactaaaccttggcagagtgaatttatggtgatagcaaaatggtatgtggggaagttgtctccagaaggcttgggtcacattgttttcctccttgtcaaaagctattaaatgtgaaatagagtatttccttctgtataatttttatgggatttgaatgataggtactatactacactttttctaaagaaatatattatgtcatggaatctgtgactactagatatggaagacaccttagaattcatgtaaccctacccccctcatttgatagaaaaagaggcagtgtcctggagtacttaagacatttacccaagatctcatggtagcaaagcttagattaacctgtcatatattgagattcaactgggaatatttccattttatagcaagttggactaaggcattcagacctttaactggacttactcatttcagaaagatagttgctaaagggactgatctagctacaagtagatagaaatgactggtatctaaagagtacaactggctaggtgcagtggctcatgcctgtaatcccagcactttgggaggccaaggcaggtggatcacttgaggtcaagagtttgagaccagcctggccaacatgacaaaactctgtctctactaagaatacaaaaattagccgggtatggtggcgcgcacctgtagtcccaactacgtggaaggctgaggcaggacaatcgcttgaacccaggaggcagaggttgcagtgagccaagattgtgccactgcactctagcctgggtgacagagcgagactccatctcgagaaagaaaaagtacagctataacagttttgtgatataggcattatagtgaagaggaattatattcattcaagataaagttatggagcatcttggcaagatagtggaataaagagaagattccaaatttatgaaacctgggcaggctaataagctattgacttcaaagagatctttaagtaaatagtggagacctaacctccagattgggattcagagataacgtttaatgtgaaagactttgggattcattttaacaacagtgagaagtaatagaagaggtttaagcaagggggggtggcacaatctgatttatatttttaagcattggctctggctgatctgggaagagtgacttaggaagaagagaagcaatagaacagctaggaggctcttgtactagcccaggtgagaaataatagtgcttggacaaagttaatggcagtaaagatggaaagaagtcaagtctgttttgcagggtttgtgtggtgataagtgagggaaaggaattatgaagaacttgctccaagggttctgatatgtggatgatgcttgagtagagcaggtttggtgggttaagatcagtaattcagttttagacatgttaagtttgagatgcctataagaaatccaaggaaagatgtcaagtaggagttggatatatgagtctgagatttaaaaaaatagccatattaacattggactactcactgttcagcaaataatgaaactaagaacgtcatcaagatggtgggctgaattaatgatattctttaattacactaccatcatcagctgcatattcagaactcctaattccatgagttgacagaaaaggtgtacatgtgtacctatataaatacatatttatttgaataaattgataacagcatgggaaaacaagaaagggtccctcccattagtggatggaaatctcaggaattcctgacagatactaagcatggggaatcacactcatggagaaataaaacctggtggagtcacagttcaaaacatatacagatcattgtgtatcattatgttcttgaggtaggtgcagttcccggtagagccaaactagtcagattcaaatagtagggagagggtctgaagtattagataagaagatacatatagcaaagctaggcctgtactgacctcctcctccagtatactgtgaatccaagctgaagcactgaccttaacataggccagagaggctgggagatagctcaagagaccttcgaatgtcaggaagctcaaggagcctcatcctgagaagataaattcctgccatgtacatgacacctggcatgatgtcccacatttcccacattatcaccggaggtggggaatagtaaacagaaacagcatacacagacagacagttagggactctgaaacgatctcactaccaagaatgattaaacatttgaggaaaacctatggtagacaaatgaggcaccaaacttaataaacaaaaagtaatagcgagtgagacaatgaataagtaacagagactttgaaataagtaaaagtaagattcatagagagaaaagagattattgcatttataaagaaatatgtattaaaatgaattcaaaccaatcaaatatcttagaatttaagaatgtaattatcaggattaaaatgcataattggactaaatagagtggacacggttaaaagcaaattaatgaattggaaggttgaattccttcagaatgcagttttgaactgaaaaaggtggaaagcatgaacaaaaagtcacatgatacagaggacgttctaaaccttcagcgttcatctgatgtaaaattgaaatagtatggagttataatcacagaagtaataggaaattttcctgaactgaagacagacaagtcttctgaaaacaccttatgaatgcagaagtaaagaataacaaaaggccaacactaaattcctgcttatgaaatttcagaatacgtgataaagaggaactgactaaaagtattcagagagcaaacagtttatctgcaaaggaaagaatgagattgacaacagtcctattattgataaaaaataaatgatagaagatagaatgcagtagttgtggagttgtgggaaaaaacattttgaactcataattctaaatcaggcaaaccatcaatttagtgtgagtggaaaataaaaacaattttgaaccttctctgattgtttcacaccttctttgaaagaattgatggaagtactcccttccaaaaagcaggggagtgtccaaagaagggaaagacataacatgggaaacatgtacacacagtaaaatgtatagttgagcctgatagtttttaaaatctataatgttaatctttaaatatttaagtctagatcagatcagttcaacatgggagagtagaagaaaaagaaatgataaaaagtattaagattctttttcaggaaaaagattcagatataaattaactctagaatttgattaaaaatataacctgaaacatatgaagaacaaccaccaataagatatttaatataaatcatgagagtaaaatgtaaaaagtttataatttcatccaaaggtagagaaaagaaaataagaaagtataggaaataaacaacaaaatataaggagataggaataagtaataggtatttaaaagtgaatgggctaacttcccctattaatagaacttaagactttaaaaaataaagtacagctctaacttacatatgtgcaagagacactcctaaagaaaaaaaaaacaaccttgatattaaagatttggattaaaatattccacataaatgaaaaagacagccatagcaatgttgaccttagacaaaatagaacttaaggcaaaatcatgaaataggaaaaagaaagatatttcatgttaataacagtcttccaagaaagtatgattgccctgagcaatctgttacctaacagcatagcttcaagaaatatgcatattacaaacttttctaaaaattagatgagacaaattcactgtttttgcaggagtcttagtagaccataccatattaatatatacattttaaaaacagcttgaagctaggcatggtgacacgcacctggcctcagctactcagaacactgaggcaggagatcatttgagcccaggagtttaaggctatagtgagcaatgatcatgcctttgcatagccactgcactccagcctggatgacatagtgagacccccccatctcttaaaaagacaaacccagctttattggttcataattgcacatcatacaattcattgatttaaaatgtacaagtcagtgatttttttagtatagtcatggagttgtgaaaatagaacatttttatcaccccaaaaagaaacgcattcattagcagtcattctccgttgtcctttctttaccagccccagacaacactaatctattttcctctagatacttcatatacatggaatcatacaatatgtgggtttttatgattgacctctttcacttataatgttttcagaggtggtctgcattgcagcatgtatcagtacttcattcttctttatggctaagtagtattccagtgtgtgtatgtgtgggtgtgggtgtgtgagatattttgttcattcatcagttggtaggcttttggattatttatacctttcaagtattataaataatgctgctgtgaacatttttgttcaagtttttatgtatgttttcatttctcttggatgtatacctcagaatggatttgctgggtcatttattaacacataattttaaagccatgtcatgaattaggaaaattatttgccacaaatatatatgtatatgtgataactgcatattattaaggttttgttttattcttgatttatatacatttatagttggtttatataaaacatttacataaaatatgtaaagagccactacataccatttactgtggaagaaacaaatttctctctatcaaagaaacccaaattttagagggtgttattatttcaacctaacaattaagtaaagttgtaataagatgaaaatatctgtgcaagtcagaaggatacagtgaggtgaacattttatatacactgctggtagaagtctaaattactatttctagcaaatagttaatacctattaaaatgcacttgtaaaaatgcatttcttttagttctccctttagctagttctaagacaataagaactgctgttaagattcatacacaagtttactgtaatagcaaaatattagaagcaactacaatagcaaaatagtttttaaaattatagtatgagttgaaatatacaactatttaaacaggctttcaaggaagatttaataatgtgagaaattgttcttgtagtattttaaaatttcaacaaagttgttgctctagaataaaaacaatttgtgttttaaaaatgtaggcatgtgtttacattgaagaaaaaaaactaagcaggtgactgatacttgttgatgtgattttttttcactttttgattttcaaactccctatagtgaatatgtattaggaaaaatttgttgtaaaatgtatagccattaatagatttcccttacaatcagagtgggactgaatttatttttagtctggacttctaagtgctttcagtataaacttaatacttattttcattttgatttaagatatgagtagatggacaaacattgctgtttaaaaaatgaaagctgttcaaagagagaatgttaaatagatgaaataatagaagctataatattatttcaatagaaactaaaatacttttggtttaataacagctaaaatgctaaaggcagcgttccaatccttgtcttaggagatggggagaggtgattttaaaaacacatgcctgtcattatttctggagagagaggcagccagtgtggtcaaatgacaacatatccctaactgacccctaaagactttgctggaaagtgacttgatgttactcccaagaaaacactccagagtgagagcaggatgatgcaggtttggctctgttgagttcactgggacgtggggaatggtggtttagcttggccttgtcatatcctgaaagctcaacttaaatacattggatttacttgataattttttcttctttggactgtgttttcggtactttcatgctcattaacacctccatttggtaatgaacacacacagtaaagtaggaaagactcagaacagtgctctttcctcctttgtgcctctctgttagatcatttggtgatgatagagaatgaaatggttggccaaaataagtttttggaactgttattggattctatatccaggccatctttattcttcattattgtggataatgaataattactgtaaaaggaaaatcatcttcccagcggaaatttttcacagtaaaacctcaaaggtgggaatttgcattttctttcattcctgctctgtggaatcaattctatgtaaaaacaaatcaaaaaaataaaaaacaaactgttttatagtcaacatgtagagattattaaatggagttttagtttaggtctaaataaagtaaggtttcttgcctgttctacagtgtttgctcaaatcttttaaaacattttaattccttaattatcatagtaaagtgggatacagaaaagagtctgtcccatgcccggtcacctaggtgacttttgtttggatttttgccccatacacaaaagcagtattttgaaatagagaaaacacaaaggtgaaacagaggaaattgttctaaaactgagacattatttacacaggtgaattctctgccaaaatggttttgcaatgttgtcccttgactctaaggcccaggatatgggctgtactgaatctttgctttacagggtattatgagtgaaattcagacttagccttgcaattcagatatttcattcacttgtgacaaagcagagacctaactgaaggaaaacaagtaattgaccttgactaggtgtatgaacccaactcatgtgttagaatttgctatttattccttaaatttcaagttttaaaatttcttttctgggtatttttcccttcaggatgaattatgcttcctatgttgaaatactagctttagttttctcaagttcctggaaatcaccaacaatgtaataagccatgtatacacacacataacctagtgtaacaccattacttatctttaaaagaaatgtgaaatgatagcatgatttgaagaaccttttaccaataatgccttaaattaaaatgacatatctaatttcctttatcttttgtttgcttactctgtgtatgtcattgaccttggcagtgaaactagatccatttcagtttcaagttcaccttctagttttcgtgttagcacagaaatcactgttacagtttctaaaactttaagttactttcagtgtttaaaactaataattatatgatcatttaaaaaattatatataacattaaaaatactatcatgaaagaaaagattagtaaattctactgcattagaatctaaaacatctctcagtcagaaaacaatatatagaccatccatagacagggagaaggtattatatttacaacacataaactataaatgatacagaatatgtaaaggtctcttgcaaatcaagacatgaaaagacaattccagagaaaaacaggcaaaggctatgaacaggcagttcacagaagaggagatacaaaagaataataaagctatgaaaaaatttctctctcttaccatgaatggaggaaatgcatgctaaagccataaacccttcaggctgtcaaaaattagtctgataattcagatgttagcaagcatgtggaacacttggaatcttgtacattatttatagcagtataaattggtaccaccactttggagagcactggaagttaacagagctggagatgagaattctcttcaactcagcaattctgttgcagaatgtatatagcctagaaaaattctctaaaatgaacctaagaagacatgcacaataaattcattgagactgggcacggtggctcacacctgtaatcccaacactttgggaggccgaggtaggaggattgcttgagcccaggagtttgagacagcctgagtgacatagtgagacgtcatctctacaaaaaagtaaaacaattagctgagcatggtggtgcacacatgtagtcccagctactggggaggctgaggtgaaaggatcacttgggcccggaagataaaggctgcattgtgttgtgattatgccactgcactccagccagggcaacagagtgagaccctgtgtcaaaaaaaaaaaaaaaaagttcattgaagcaatatttatagtagtgaaaatttggaaatactgtgctcatcatctggaaactggaaagatacactagtaaagtcaagactgtgaaagaacagatagagcagtgaaaatgactcagaaatgctagattaatatggagaaacctcataagatgtaatgttaagcgagaaagtaagttgcagaatatgtacagtattatagggctgatataaaatttaaaaatatgaaatatataggatttatgaatacctatatatagtaagattataaaaataagcgcagaatttaagatgatagtttggatggggcatggaacgagagaaaaatgggaactgggagaggtacaccaggagtttcaatcatatttataatatcttatttcttaaactggttggtgttgcttatactctgtaacttttgttaaatatttcataattttttaacaagatgcaggaaagcttggtcaaatgctacagatgctttaactcgggaactttggctttcagttggttttagtgtcttccctatatattgatgagtgtgtgtgtacatgtgtgttttacaatgagaatttacttataatcagaaaaaggtaagctattttcattgttagtgaaaatttaaatatacatttcatattatatgttacctttcccttcataatattcttagaaatctttctcaagcccctaatgttgcacgaagtcaaatgctttgtaaggcacagttttgacactatcttaaaaaatatcttatctcataaatgcaggtttttcttctgtgaattttaggaattaaataattatttttcccccatggtcattttagacagatgtggcctacgacaaacctgtagactgccaaatttctagtgcttatatacagggcagagttgggtagagcagatgtttaaggaattatggtatcatatgttacagtaatggtactgtcatttaactagcatttatcgtatactattttcttttcgccactacctgcttccctcactcttaaattatttaaatgagaaaccttaagattatgcaggggagtttttaaaaatacctaggctacatctccagagtttgtagtttaattggtctgggggtgggccccacatgccaacaagcttcttaaaattcacatgtaattcaaatgtacaaccagggcggagaatcactagttctgaaaatacagtcagtagactagcagcatcaatatcatctgacaatatgctagaaatgtgcattctttcacttgcttcccagacctgtaggatcagaaattcagggggattggaccctgtagtctgtgttttattggcctgggtttgagaaccactggtctctaatgctcctcaaacttgactatgcatataaaatccctttgttaaagatgcaaactctgattcagttaacctggagtgagcaatgacagtctgtgtttctaggaagcactcaggtgataactgtgctgctggtctgttttgattaacaagagaccctgctgaaagtctcctgggccctccctcaggcctgttgaatcagaatctgattttaacaagatttctaggtgttttgaatgcacattgcagtgtatgtaatgtaggaggaaaattaggacatgccagtatctaagggtgagagtttgaagaagcaaaaatcagtattgtgaaacacaaccaagatgaaataggaacagaactgaaaatgtgtcttttgtgtttaattttaaatgtttcctttaaagaaattttcctttaaagtgaacgtactcatttaaaatattgatgattaccataaaaataatttcactggagtggtggaggcagaagtctgaaagaattaaatccaggactgaatgaagtgtaagcatttgagagacaagtgtatacaaatgtttaaggaagagagttatttaaggaggtcaggatttgaatgtgttgaatgtcactgggaggagggagaagtggagagtgagaagttgaatatgctgaagagggaggcagctggttgcctgaggagatggcatccacaggatgcctccaggaatagcctaaggaagaaaatggagaggagctccagagagactcctgtggggtagtaggtgcccggcaagagatggaagatagcaggactgtgaggagttgttcccctacatttcttatcttctctgtgaagcaggaacctactccctgctaactgctccctcaacacacacaaaagaacagctagtgttaagtgtctgaaatcacagtatttatttgcttactgtgttcctcttctagtgcaataaaagcccttacatgagggtaggctgtttccacttcttgtatcttcagctcccaggacctggcacatggtagatattcagtatttctgaatgaatgcatggtagattattggtatagttgaccatttattgtattttttaaactttattataaacacaccataaaattttgcagcctctccaaatttttgttgaagtgggatcagaactgaaaatgtgtcttttgtgtttaattttaaaacaattcttgttcatttaaaatcaagaaaatgtagcctggtcacaaatgcttcttagatccaggtgttttgaatgcactgtaatgtaatgcactgtaacatgcattcagaacacctggaaatcttgtaaaaatcaaggttacattaaaaagtgtagcctttcacttaaaattttaaacctgaactgttaaataatatttttaaaatgaaactcctttgaagaaaatatgttgaaaatcattgtcttcctttctagttttcttccagtcttatactttgatcattaaaagtgttaagtcctttatgttcaaggtaagaatctgttcagttttttgtccagacagggaccatggtgttttcttgcagtctggatcatttcccatcagaattttgactgtcacattcgtgtgtctgtgtgtgcatttatatatatatacacacatatatgtatatgtgtgtatatagtcagccctccatatctggggcttccaaattcaactaattatggattgaaaatattgagaggaaaaaaaggatagttgcatctgtactgaacatgtacagactttttttccgtgtcattgttgcctaaaccatacagtttaacaactatttaaatagcctttacaccgtattaggtattataagtaatctagagatgatttaaagtacacaggaggttgtgcagcataggttaaatgcaaatactacaccgttttatatcagggccttgagtacctatggatttgggtatctgcagggagtcctagaaaaaatcccccataccaggggatgactctgtgtgtgtgtgtgtgtgtgtgtgtgtgtgtgtgtgtgtgtgtgtgtgtacaatctcaaccatgacagtttctttttaacagagtattggtactcaattaattgagaatagttatgacaaatgtttaaagatgtcggtaaaaccacttcattatttcataaatagcctttttttcttattttattaggttgtatttggcatacaacttactttttatacttttgtatacatttttagagctttaatgttcagacttcagttacctgaaaatattctgtctcatttacacattctgtgatctggaacactgatccagtctccaattttgtgtctcagtgttttatacctgtgtgaatttcaagcccttgggtttagttgatagtgaatggctggccttgtgaaggcctcgttaacatattcaaaatgtaatctgtctcaaagctgaggtagtgaccagaataaccaatgccacattctttcccttctttgtgatagaatgctttgtgtaattcagtgtatggaggtgacacttacagctctttattaattgaccttttatgagggctgttacttgtttattatatttgccatctaaccaatgatctgaggacgtgaaatgtcttttcaaaaggtaccctagaacatcgtttttctgtgaattggcgagcaaaagtttcttgaaacctaataggataggagagagctatcttgcatacctcatctcttttctgttctcttttgacttggatctttctgtgggagttctgtatgtgagcacctgcttgaaaggtgtttggtagtttagggccagagagcattagaatggccatgtagttgaagtgagaatggctaaggaaagtgaagaaggagtgctatggatgaaagaactggagttctttaatttagcatacatctccatttctttaccccctctgcaaggcatattctgttctcggtggaaataatccttaccaggacagatcagaggtagcacttataaaggaatgttctttgattatgactaaatcagtaattaggacttacaatgtaaagtgtaatatctttatccaagaaaaactttgttgcgatgggattcattggaatagaatttttcctttaaagtgaacttattcatcaaaatgtaagttatggaagttcttagtaattttatctttgtttgatacagagccctaagggagtttttagtgtactggttatgtgtggatgcatatattggttgtgtgtggatgcatagtttgtagactaaaaatagtagaataagattactccaaaaatgtttaatccttcataaaggtattactgctttgctaaattttgggatataattatatgtggataaccatttggcacactaacaatcttggatgtaatgtttaactttactcatggaaaaaaccatgtaatataataatgttcacattagaaaaaatgttgagaacccaaatataagattgtgctaggtgattatagcaattgagaagagaaataaaatgtggaagcactatggggggccacttatgagaatttcaaaactgtatcctgaatatctgatacttgctatttttcaggaatgttgattaactcattcctttatatatgtgtgttggagtgtgagttgatcatgatctttaagaatagcacaggcaaatgtaattacttgtaagattatgttacattttaaatttaaggggaagacatcatcattattatagggacagtatgcattaaatgcataatcctgcaggaaggcctaaggtataagagttgaagtgggaaataaaccctgcctgcaaagtgattttataatgtggtacagagacaggaagggtggcctcgttgaattatggtatgggttcactcatggcaaagttctccgtccaatctatcttatgctatagacagttgtgttacattgtctttctttctggtgatcatggaaaggaattctaatgataaaagtctgtagtgagggaaaattatattgacaagagagatttccccccccccccccgggttattctcaacaattaaatatcattaccatgtaagaaaagttacttatcctggattcgtgtagaatgaaaattgtttttcagtccacagaaatgcatgtgttgtcgttttgaacaactaaccttaaaaaatctatttttgggtgggatagtaggcaggttagcagccttcttagtgtacttttttttttgagatgcagtctcgctctgttgcccaggctggagtgcagtggcgcgatctcagctcactgcaagctctgcctcccaggttcacgccattctcctgcctcagcctcccaagtagctgggactacaggtgcccgacaccacgcctggctaatttttttttttgtatttttttttttttagtacagacggggtttcaccatgttggccaggatggtttcgatctcctcttagtgtacttttaactctgctgatgtgttgtctttaataatctagagcagggcacccaatctgtttattgtactgtattattaaaaagtgtatattcttttcaaatgcttaatggaaagggataattttctgacatatacaaggcttttgtttcattatttattttgaatacatggggccagagggtatgaatgcagttaggttttgttggaagggaacttgcaaagactttttgaggcatgatgtgcaagtgagtgtttttaagtctcagaggtgtgattatgtcataacagccataacctctgggcttgctttattacttttattaaaacaaatctgtatgagggcgctatgtatattttggtgatgaaggaaatgaggtggttaatttattatgtgaacagcactttcaactaaccacagcgtgattcgctgcgagtgcagtgaaaaagcctagctctgtagaaatgactgcattttgatttgtggaccttaactttcaacaccacaacatgaagtttatctacaaaatgattcctttttttttcctgtaatgtttttgtacaatttttaatctctgtttcttttcttcattttattgtgggaaaataaaaacttagtaaatgaactaaacagctctcatcagcaaactgaagagaaaaaagggaggaggatcgacacgttagggcattagggaactgagtagcatctttttagcttccaagtatctcccacatctatctcagaagaggactccacagaataagtcaatattctaagctctcaatgaatgacgataactatctgaagtcaaataagagtcaaggaaaatgaggcacctgttcttcccttttgtaggatgcatttttaagcagatccatagtggaaaagaaaattaatatcttgtaagagaatctctgagatttaaaagttggggggggcagttgaatctctgaggtttaaaagtaggggcggcgtcagttatgggagaaggtggggatgtgtaccacacagaagcatatgcactgtagagtgggattgacagagggacttgtctgtctaacgagtttgcagtatatagaaagcacttgttgtatactcataaacagccattgaaagaccaagaaaaggttgttttccttggagtggagccatatccagcatcatctggtgatgtgaacctgcctagagagagagtgaaaacaggtcatcttcccagcagtatttttgaaagactccgtcattttccagatgtgccaagtaccaaccattaacagacaggaagacttggaaatcagtaagccatttaactgccaacaattaaggtattttatatctggaacattacaagtctccatgaaaggaaggataacaatccgttttatattttatctctgcttctttggagtggcacaccacatttctcttcagatccctacatttactctaaaaattgtgtcattccttcataacacttccccaggagagttgacaaagtccaggagatacattatttgtgtagtttaaagacaggctatagaggagagaggtccacgcctgtggtttctgtaaacagggtagactgggagggagcgctggcacgcctggttgggttgttattcggtcatcatgaccagtcattcctggtgactttgtatctactttgaaactgcttccatagtggtgattagtaatgatcatggacagtcccagattgaggtagaaatttcattttaaaattggattgtaggcataacttcgttttaatggcattggttgggcctctcaaactttcagatgtcttcactagtagaattaaactatgtcctggacatttcaagagagttatctttgatactatgtaagccagcatttaaatttttaaaagagaatttgtgttcataatggttttgctactttttataaagttgagatttaagaagttattcttgggagttggttttgaaaagtctgttactcttcctttctctcttctaaatgcccaccacaaaccaatgcagaacataagttatttttaaaacatagataatagagaagccataatttcaagtgtatccttgctcttccctgccttcctcagcatttccttctgtgcctgcttgctatgtgcctgtttcctcgactcccttccaaccttctgtgagctgccttttgaagaggtggtttgttccctagttcctcattcagaacccccctcatatggtgtgaaatacaaccagccttttaaaaaagtgatccaaacctcttttacgatttgaaacctagtcggatatgtgttgacaaatttaagcaactttttttagtttttcaaaatacaaatttacgggcatgctaccagaattagcattaactgaacactgacccagtgatggcagcagaatgcagaagacatccagcccagtcagctagatgatcagggcatgattgtgaataaaatggaacatggaagttggcagtgagccaggacgtgttttcttgtggataaatttacaaacttaatgtttatcattaagtttgtaaaaggaaatttggactctagattagaatacttggttagtcataccttgggcacataactatgctcattgacctatgcccatccttgccgttgggttattcagggtgtgtttagtgaaaatttccctgagagataaagatcttacatagacaggagcctgctttaaactaaaatttcagaaacattttcactggcaccatccttgttcagtgtggtttagtggaaagaacacagagccctggaccccaaagtgagctatggaccttggtttagctactcatgtgtcatgtcaccttgggaaagtaattttaccttcttggaaaataagataaggataccgatatgttttctgaaggagtgttaaagggaaaaaaattagacatggaagtgcctcaaggtgcatatgtgaaagtgttttcacttcatgaaatcaaaaaaatttcattcactttagtagttctttgtttaaacctttgatgttaaggtcctgtttattcctgttgtttattcatatgctaaccttatcaaatattcactgaatcatttaatttcaggttacaagggaccctcaaggtcatttagttcacacctgtcaggtataagcatgttcattcctttctgctgaaaggaaggacagaagcagccaatggggaaagcttccaaaacaaaggatcagagagagtggcagcgttgctgtggtcataatccaggaatgaggaagtgaaggcccattgcctgcctcttataaatagtaatgacaggacgtgttgcacagggaaagataggcatttaaagttgaattggaaagtacactttaaacttctgttagttattacctacagaattttttgtaagtctatagtgttttacttgttatccttgtgtatctgattcttctgttgtggttcacatctaaattgactcagtattttggaggtgggagtggaagagggtagaatgcttaaaaacaaacacagcagcaacaacagaaacaaactctgtagtttgttgggatgcatgatctggttatcggttggcaataagaaacagctgtttgtttgttgacagcctgcctttcctctcccctaatcaagctgtttctcatcatgtaattaccaactctttagtatttgagacttgtggatttatagttggtcatataatatttgccaaaacgtcatagtttacataaaaaattagtgattcccctgtagtcattctactgaaatatgaatgtgagttgtaataaaatacctgaagagacttctgaaattcatttcagacttaagggaatgtagagggtgttttgtgtgtgttctaaaaaggaagtattggtgtaactcttccctctcttgtagactccactgccaatctgaaaagcattctgttttcaaaaatgtagtaaggcagcactgatgtggataacaggacagattttgttctgatgaagaaggatatggttgcttgtttctgtctttgtcttttttcttaaaacactgttctaattttgaagccaagtgtgaaaggaaataaagttgtcagagggtccaagatgatgtttcagtcttctgggtagctttagtagcagaaaaatagctgaatgtacctcctactctaaagagacttaatttaggccattttgtaaacagactactttcagtctggcttatgctgagtgaagcccattttgaaataaaggtaatcctgtgttttaggaaaacaagccagaaagggtgaggcttctgttgtttcatttagttttacccttcaaaataaaacaaatgttttctaatcacgctcaggtcacagcttctctcagaatggaaaagtttctctcttcaattaatcttttgacattgcagagatagttcagaaaaatccccttaaaagctacagtgccaaaattttttattttcataaactccaaagtaacatcacaagttctccttggtttgataggtttaaaattataatggattttagaatatattattttctctttgatctcaaagacattacataaattaatttttattttaaaagagaatatgtgaatagtaagtgctttttgagatatgagctgtaactaggaaagggaataatttagtttaaaatttgtaaaaagtcaaattttgaaaagcatattttgtatgagtatagtttctattctcatttgcattgtgtttgtactgtttttcatctgaagtttacacctacatttttttctaaaagcataagtccttgaaaatattttagtttaaatgcacgtgtcaaatttcttggtctcttgaagtcaacagctcccaaatgttagctgaattagactatcagtgatttcaccaggtggctagtgacagttaatatttaggtttttaccagaacatgaagtgtttgtcggggtatttttttaacatacgccgtgagaatgacatttcttatattactttaaactatttaattgcagttagtatcaaggcaagatttgtttctttatcttaaaatattagctataccatgaagttgagatttgaaataaaaagattacttctagcttaattggagcaggtaggaagtggtggcatataaaaggtgaatattttcatatgcacagctgtgcatgtattcttagggctctgttggccaaaatctgttgtcctagtagtgctcaggtgcataattcagtcagttgaatcacagatgatccattttcaaagcactttagtagttgggtgtcaagggaaaaaagttgtaattttaagaacttcatccgcaaatcatgtaatggtatttttaattttagcttcccaaatctgtgtggacaaaaattattcagttataaataaaagatgtgtaaatccttattccagtggccttctttggggtgacagggaggagtattaggcgatgttacaggatattgttacagttttatattttgtttctctgtgttagacttttctatttgataatactttttcaaaaatgatgctataaaaacccattattatagagccattaaaaatacaggtctattatccagtgattaatatccatgacctttatttttggatcggcttcataaatatatacattttctatgtcagccattgtctggaatttcatttttgttctgctttccattacataccatgaattaaatgaaattaatttaatcgctactacaaacagaaattaaacgtgccctaatccagagttacgttgtttgcttttacaactgtaagtcataagtaattaattttccttggaaaattaattcacttagcattcccagtagcatcatatgttgacacagggttatagatagtttaatatttttcttcagcatgctggcctcaactttagaagaccttaaatgaaaacaaattaaaatttactcaactgtatgtaatttggggctatttaaaataagtgttgttgttattgatagcatccaggtgatgactcgaaaattatactcaaactttacaaaatgcccattatgtattagcaagtctgaaacaatatattttttaacattggttatatgacagtagccattaatattttctgtccctcaattctgaataaacatttgacatgagaaccatctaacagcagtagcatggaaagttttttttaccatcacttaactgtcaagaaaacaaaagggttaacttacttgctggacatttgaccacctgggatagcaggccatcctgtctgattcttacagagcttattttcagtctctcacctcggtcagcagaaaaatttctatcaaggtcatcttaaaacatagaatatattgattgccgttttctaattgtttcattctttcctgtttaatactttttttccccttactttccagaaaggccagtgtggaaaatgaaataagcagaagtctttcagttaaacaagctttcccccactgctttttatattctggggactcagaaaatatgagcaaaccaaatttagcttttcttttgcatttgccaggaggttatttagtaaggtgattttttttttctggttcacagaactctataaaacatatagtgtttattactttatgtatatttatttaagtcactaaggtgaaactgtagtgatggtggcaatgttacagttttaacaagtggggcttattttataaatgtgtctttgtggcaatagctttcaaaaatgcacagggttagcagtgacatgctcttttggaaagaaaatttgctgtttaattccagggtaaaagtactactagaacacaaaatcaccactgttatttttttattttttattttttggttactatttattgttaaagtcaactttaaaaaaatctgtactcgcaggatttaactaactacatacattgcaaagttgtgtcagggagaaaatgtttgcttgttatccctatcagaaggggggtgacagggaagtccccttccctatgcttcagagggtttccctctgagtggccttcagagttaggataatggctttcctctttatcatcatcagacaaaatgaaaagattacacatgtcaagttacgcacatttatgtttttgctctgacctaaatatagattgttgtacagtcaggtttaagggaaagcagtctttcaaaaataatttaggcagcccaggtgatgattattctaaaaactctattcctaaatctactatcacatacctgcaatacgattacatataaatacgtatgataatgctgcatacattcttacacagtttttaaaaaatgcttctgccttctttctgaaatgaactggtttactttattctggttttgaagtggaaaagtaaattcacccttatagaaatttactaatattaatctgcatttaatttcagaatatattctcttaaaaattaaatttaaatgaaaagagtttgtcatgtccttcattaacttttgtgtcaaaatgaatatcttagaaaaacattttatagcaaactaagaagtgtagaggaattgtgtgtgtggtgggtgtacacaaggagattttaagagtgtggagaaaagagatgctaaatttgagctacataatatttacccaaaactggcaaaggaaaactttgttaaaatatataaaaattatggattcaagaaacaaagcttggagaagtaaaattttttacttcttactttctgtgattattctgttgattcaaattagaatagaaacaagattttgtgatagaaatatgaatgtgctttttaaaaatttataatgttaagatataacaatgttcataatttgctgaatgattgtgacacatgaaaaaccgtgctgtttgtgagaagtagacaaacaaatgttcgtgcattgtaagaactctgaggaacttagagcagactatcgcttgagtttggtcaataagactttattttttacctgcaagcagagtgtaagtaatcataattattcctaaattgctccctaaagtgtggtaaaagtggggtttgcaaactgctgatatttgttggacaattagattgatgttttataacatgttactattcaatggagtccttcacagtgccgttgggtggaaaagtaaatttgtacctaaagaaatgtacaactattaatttgtattatattccacactgttctttcaaaacactaaatttaaataagtttacacttctactcacaaagggaataattaaattaaggtgatatatagaaagataaaatggcaatttaccaccacctgagattgacaaaactctcccaggtctttcaaagtgaatcatgctcccagtcattatctcacagtaccacgatcttacacattgacaatggggtaaattggattacatttttgcttttactagaaattcaaataaaatcttaggcaagatagggaataccacattgtaatatcctgcttttatgcttctgttagggctgtacattagtctttggctaatagatcctgctagataacgctttttccttttgtagcaccattcatagtttgaggctgtcttcaatctgacctgtaagaactctgcttcgaaagactgtgtatataagaatgttggaataatttaatactcacattttgataggtttaaaatgaactggagatttatgttaattgcagtggacgaattgccacatttgtcctactaaagttgcttatcagaagaggaaaatgagcagaagaatctttaaaaagaatgttttgtctccaaattattttatatttgtatgttaacccagaactttttctctagtctctctctgtatatattagaggagtaatttctgagttttgtttttcatcagatttgcagtgaagattaaaaacaaaaacagaaagaacctctttgcaataaacatcactaccacatttaagtttgtaatttttataagaaaggaacactagttagaagctatttttttttgagttttaatatttaccaaatttataggaactctcaacatgttttacattttttctctccatgtatgtaaacagaatgaagttaaatttagtgatttcttccctggagtgattaaaagtaatgtaatttgtttgttaataacaaacttaaatttattttgacattattgtattttctgtatactataatgtggaaaaaagtacttaaggaatggagagaaatagactgttctagctaataaaagtgcttaactctggaggggccaccaaggagtctgtcatgattgacaagcattctagtggagtctttctttcctttttcttttcttttctttcttttttttttttttccttatagcagtgttgaagtcagtcaaagtatatatacaaagctcggtgaataccagtttccccagtacaggggctattttttcaggaagtctaactcaaaccagatgttttgcctagacctagagtttgttgctgccaagcatctcatcagaggtcagagttctgggctctgggccctgctagaattctttcacaaattgctattcggtgaggttttaatcctaatggaaagaataatgtgcttgtaaaatctgcagttattacaaacacagtatacatattgtggacttcaaatgactacgtatttcatccccataaacagggaatgcagatgaatgccttgtgtgatagcttcagacattctaacgaaaacctagtatacagtttattccacattaaccatttgcatttgtaataccctaataaaagaaactgttatttttgggtgacaactggtaaccaacttacgcccccccaccacaaccaatttttttaacaagctctacaaccccatacagctgtttgaacacaagaattaaaaacattcagaaccaaatattggatattctcataggaagatctatgaatgctatagtactaggtgaaaagttcttaaagcaaaagacaccagtatgccaagacttagctatcttatatttagaaacacatataaatgtattaaaaccaaattcatttattcaaattaggatgaagagtatttttctttgtaatggagaatgtgattggtatttaactaaacatgagttatagctctttgggaaaggttaaagacgtgtactgagattgattatatctctgcataattaattttatatacaaatattatggatattattagatgcttacttgggggcactgctgctgctgattataagcctgagagaaattctcaggtaaaagtaggcgtgtgaaaccagagaatcacaatttggcttagaaataagaaggttaattaaactatcctgcagcaattaaataaatctgcagttaagttagatgtggcaaatttttatcaaaacagtgaaagcccaaatttctgaaaatgagaaattgaactgtaaaataaaaattttaaagacagattctaatgtccctgaattactccttaacatatgaaagcagtttttggtttgaacagtttgtagcatttatttgggagtgggagtctaatttctaaatacctttttgtttttatatttaagtaacaatacggagtataataaatatgtaaacaaaacttagtcttcaagcaaataaaaattggttaactgtgggatcccccaaaattttaatgaaacattaaaattttttaaccacaatttttatttttacctctcattttatttttacctctcatttatgtaaaagaaaatcagtttttatttttacctctcatttatataaaagaaaatcaaaattgatatctctactgcccagacagacaattgcattggtgttgagaggagccatcatttacatgaacttaaagtctcttcgttgctgccagcaaatggaaaaaaaagaaaagacttgttgaagtatgtaatgttaaaaaaaaaaaaaagtttggaggatatttgtgctttaccactttctaagttgtggaacaattttaaaattctattttctgattaatctttttgctgttgtgtgtctctgaagatactgtatgccggcagatcttctgcagagtattttctcaaagaaaagtgatgtgtatctcatgaatgctatctctcttccacaaaatctctgatagtatgtcatacctagtactctgtcatttaatatcagtttattgtataattgccaataagggactttttcttggaagaaaggtgcaatattaatgcacagtatttttattacctttggtattctgaaaagcgaaataatatttttcatatgttcaataatttcacccccgtaaagttaggggataccatcatctatgtctgtaaagacggtgagaataaatgccaaaacttgaggctacatttcattctgtatggcataatccattcaagtgcaattaaaaaaaatagtccaagactatgatcacttaatgagaaacaaacaatttcatattaatgagttcccatttgccaataattctgtcatttgtagcttgaatcagtcatcaccctgcaaatagccctttcaagacattatttgcaattttgtcctttgttttctgtccttgatgttgtgaaaatggccgtctactgttacaggaatgaaaagagatcccgttcaaacatcttttgtgtttccactttcagtgaaaaatgtttttcaaacctgcagctggttatttctgcaggagttcccacttatgctcagatttgattgacattttgaaatggcagcttttcatgaaaagctgttaacttgtagaattcagttatggcactaagacagactgactttgttctgtggctgggacctgtccaaactaaatagaaccctgcatctgaatttaatagtgctactcagccaagatagggcacttttgccttttttcccttcaaaactctgatgcttcttatatgttctaaaactaacttgatgggtattcatcccaacatctttctgttctgtaattgctttaattgacgtatatagtcattctcttgttccctcccttgaacatctaatggactaggacagtgctttaagatataatgctaattgagaagaacttcttaattgataactaatgttacagagcacagaaaatttaaaaatattgtaactcttccagtatagaagatctaaaatttttggaaacatgttactactaaagctgtagattcattatgtgaaaaatagtttgcatttggtactatacaaatatatagtttattaacatttttcattcatttactcaattatacctacaatttcaagggaaatctgctataaaccccacaaatcacaaagttcatgatccctgcccttaaggaactttgaattcgctatcttctcattatacttaacagagaattaatgcttccaagtgtgccaatttataaaattatttagtgataatctttaatttttcaaatggccaacttttcttgtatttgatttccatataacactctcacgagatgaatggaaaatttagtatcgtaggcctcctgtgcttctttttgtggtcttatgtcatctgttaagaaaggttaaaaacctggtttcacttccaagtgtttgggcattattggtgttatatggagccattaaccctgaacagctgtatgtgatacctggtttcacctgccttaagagagagggctgtgacatacaatgactatagacccagatcacccttatgaagccctgatcacccttatgaagcactggtcttcgccttctcagctcatacacctgaagttgaattgaagtagttgactcaagatgactctagttcgtgttaactgtagctcgcttatttctgcggctttactcttagatagctaatttccacagcatatccataagagcacaagctagtgctacacagtatgccctctgagaatgttggtgtaaaaatacagtgttttaatttgtatagctctgaaaaaaacttcggggttgaagtggttgaaatattggccaaaattatagtcctaatattattcctggattttagtatcacacccttgttatcatacagcttagatacttgaaataaaaccatacatatccaggatttcagaggatcggtaaaactttacaatgcactgttagtaaaagtaatataactttgaagtcatatggcgatttcagaatcaaaattacttttaaataagtgtttaaaatcacttattttatgaagcgattttagaatcttaatatgacatttattaggaatatccgtggactcacagtcggtaaacaggtagccaaaagggcattcctctgtccttctgagggagtgtaaactgatttaactgtttcagtgtgcagactgacagtgtgtatcaaggtcctcaaaatgtcctgctttgttttgactagttctcttttgagcattatgtcttaagcaagtaaattgttatgcataaacatgtttttatagtgttacctataatcattgaaaactggaaaagtaaagaaaatgttcaataaaaaagacattaaaatttgttcatataattgaataatctgcaatcgtttaaaattaaacttccaaagaatttttaataaaatgtgaaaataaaatgttcaaatagttaaaagctgggttcacatttgtattacagaagaaaaatatgcctaggaaaacctgaaggaaatatccgtaaaagttaagatgagttgccccaggtgataaaattgtattagtttcttcttctctttgtgcatttgtgcactgctctaatttgctgtaattaaaacatgtaactttttttcccctaaggagaaaaaagtatttattaaatgagaaatccagagaaaaataatgacacattggaatgtaggaatcctgttttctaatttctttcagggtagcttcagttcttgaataatggccctagttcaagaggtgaaaaatagttatctgcaggtctattccactagcagagtatttttgcttgtctagcactaaaatttttaaataatgtaaatttgaaggtcgttagggcacaagcctttccagtttaccctaagccttgacatctttctcttgtgcctgtgtgatttcgacatttgtgtaacctcccaggcctctgagatgcaaatgttgcatttttccagctctgtgcctaatgctgaatacctttgtcataatagtagaatggtccactccaagtttgggattttgggtttttttccttactcagcatatggtaatggtcatggtgatcataatgtttttttgttgagcctttttgtagtacccagtttataataaaatatattattctatctagttctaataattctgtatggctaggtgctgttattttccccatttcgtagataaaacaacttgaagcacaaagagattaagaatctgttaatagtagaggcaagatttgaaactaagtctacctggattcaaaatctgtgctcttaatattgataactaagttatatgcagaatgattatattttagcatctctggaagtctttaaccagtaataatcttatcttattgaagagaggactcagtaacaattgcttttcctgtttctgtatgtcataaacgacatggtattatttaatactctcattaaacaacaaattattaaaaatgcatcctttaatactcttattaaacaataagccatgttattttaaatgtatagtagttgtatgttgtatgttaagatatggagagaaaatactgtttactatggaaacttgatgtaaatattctctgccccaaggaatggtacacttatataaaattatattagcttaaaatgtgtaattctgatatactcagcttttgttacgtaacatattcaggaatataacccctacaataactatctaagtgtataaaaagaaagctgtctgttaaataatttgatattcaactttcatggttttatatgcctaatggctattcttcaaatatatgttttggtttaccttttggttctattttggcaaaagaaaccaatttgggagattctgattagaggcagaaaattgccttctatatggaacagaaaataatgtgttccaaaatttttaatacccttatgagggttaaatcacttaactctttgtatctgacccatttaggaaatgtgacatgccttttcttttttttttgtttttgagatagagcctcgctctgtcgccaggctggaatgcagtggcgcaatctcgactcactgcaacctctgcttccctgagttcaagcagttctcctgcctcagcctcccaagtagctgggactacaggcgcccgccaccacgcctagaatttttgtattcttattagagtcggggtttcaccgtgttggccaggatgatcttgatctcttgacctcgtgatccacctgcctcagcctcccaaagtgctgggattacaggcgtgagccactgcgcccgacctcaacatgccattttaaaggtaattttttacaagtgatgggaaaaggaagaaagtcacagaagtaatttctgctttaaactctttaaggagaaagtattcattatgcagatagaaaacatttattacactagtagtacatagaaaattagaaaagaataaggacgtaaaaccctgccactgatggatgactgtttggaggtgtataggaagtaaatgttctaagttcatgcatgttgaaaaaggtattttgccctcctgcttgaataatagtttcagtggatgtagaattttaggttgcaaatattttttccttaatgatttctttgcatccattcttttgccttctaccacccagtggtattgatggcagtctgatgctcattcctttgagagcgacctatgtttttaatttttggaagtttggggtgtttttgtttttttgtaggtgttctgtggggtttttttttttccatcttgatatgcctagatgctcatgtctttttattaattgggttgaacacttcttgtaccttttgtaatctaaagatgtccttcacttctgggaaattatcttttgctatatatttgatttcttattcaatattggactgttaggaccagacttcacacttgaaaactcagacttgggaaaaggatccccaatccttaagatgtgagaattaatgatttgggaggatccttaaggattaaggagattcaattgtggtagggtatggcagaatttttgcctcttctcttgttctcctacctcagtatacatggttaggggactccctgctctcccccaggcatgataatggggacttagggtctcaagacttgcagttccagcattaaagacattatgaagcagggacctgattcagcacctcagctttctatcaggattgattagcttatgctgtcgttcccatggcatactgtgcagaaggccaacatctgtgtgaagccaacctgctgggaatcagtctttggcatgtcaattcgttcttaggaggcaactgttttatattctgactttgagttaatgccctagatcctgtccaatatggtctctgacatatcccaagtcagacctctctagagggtctgcctgacaggagccacttaactgtgtccccatcatgtatgtgtcagcctacaacttcttccttctgacttttcttactcaagacacctaatactgaagttttgaggcaaacgtctgttcctagccattgaactttctctagtagcaggtacatcatagaggatttggcaagggaaaacaccctggcctttactttttaaaccatgtttccatttttgttgaactttactggggaaaaattgtagaacttgagcctttaaatttaatgtctgttgagatgaaaacgtttcataggtgagttatcagtagttgaaaagtatatatgactcttagtaatagctattattaaaacaatgatggactctggcatggtttaagtcactgacaacatggtttttctatgctgtctaacattggtttctttaatatgtttctgactttgttccgtggcttgactaacactaattccttttctactttttttttttttttttttttttttttttacctctgggaagatattgcttctgtgcatttcacactatagagagaaacttgcctcattgtgacccctaacctatgtagtaaatcctctaaaattaattttggttccttctgatctgtgcccccatgtgactccccccaagatttcattattagattttgacagccttttaaatttgtaaatgccacaaatttgtcactagagatgaatgggtaaaaagaaaattccttgcagtggaggatatgggtaaaatatttcaagtgacagatctgcatcaataatgttaatgtttatggggtgatgaaaaccatgtaagtcttaagccagaatcttttttcagctgagtcccagaaattttgaccacagaagccaaggcacattccgtttattccaacaagtgttttttcacatcctttccaactgtctgaaagacaattgtcactcttaaatgcctgaaactttagatgctttttctactggattagttaaaagcaatggaaacattgtctactgtggtcgggatgacttttgtcttgccttgagttcctaaaatggagagcaaatttgacaatgttattttgccctctactttttatgttcatcatctggcaaagttttcaagaaattttgcatcattctttctgactgacttctgaaggcttactttcatgccagaaggttgcctttgctgaatgaacgttgagtggtcacagggccagaggctttgtctcttactgataccaaaggagttccccaacttgagtggcttctgatgccagtgcagaagagcattagtatttgagcagttgagaagtacattcagaggaaatttagagaaaaagattattgaaattatcccaattatgatgccaactaacatatgtatgtgattatttttaactaaagaagaaggataaagaactttgaaccagtatagtgtggtcctttgtctatttatttgcatattttgatttttaaataatgaacaaaaaggattcattcaaagcaaagctattttaaacttaccctgaaaagttaaaagtgattctttgggaaaagaaggaaaaaagatttaaaaaaaattaccactgtcccaccttcacccaagtgtatacaggaggtttccatgtctttacatattaacaagcttatttctttactaaagttatgtggatattttggtaaagaaatgataagcttgttattgttatctctaacttctaggctcaagtgactctcccacctcagtctcctgagtagctaggactacaggtgcaccaccacacccaggtaatttttaattttttttgtaaagttagggtctcactatgttgcccaggctggtctcaagctcctgacctcaagagatcctcacgccttgtccttccaaagttatggtattataggtgtgagccactgctcctggccagtataaatattaatatgttctggtgttagtactgtaaaatggattttcttatgtagagctgttgaagaactttaaaacttcctgtagattctctgtaacattttgtattttgccccttagaataaaaaacagctgcaccagattatgaatatttctctggaaattcagccctgtaatagacatttatggagtacctgtcattaaagattaagcgcctggtctgatgaaaattactagatatgcgtaagaaaaaatctggaagcaacactctttgtaaaactagtgggtagttatcacctctttttttttttttttttcaaaataacttcagaactatttgcatataaccactgcaaaagagttgttttgtttttctttgtttacttagctgcttacagtatacacatttccactttattccctgatgttactggttcttctccctaccacaccctgcctgtctgccaaagttttagatgtttacagtgttcttcccatctgcatgctagacagtttctaccttaaacaccattgatctcgtccctgaactccaaactccatatgtccacctgccatcttaacctttcaatttggaagtctaataggcttctcaaacttaacatgtctagaaaaaaactgttgacgtccctccactaatcccccccaccaaaattttaaaattaaaaccgcagtactgtcttatccttccctgtttctattaatggcatcatcatctgcccaattagtaaaactgcaaacctgttgtcattaaaaacttcttgttattaagattctttattcttccttttgcttcatcattctctactattaactccatctgcttctttccctctttttcctccagctacctgactctaggcagccatcatctccctcttgatatactgagaaagtctcttaccaggacttcctgttttcacttttgtctttttaaaatccattttctacagcataatttttaaaaagtatgtcagatcccatctctgttcccgttgtctctggaataaaattcaaactccttgccatggagacttacaagagcttgtctactctccagccttatttcttagtactttcccctttttttggttatgtctcagccagattgccctcctttcaatttcagcactgtagcttgttactacgtgtggccattcaaaacagtagatatttattacaaacttacttttagggacgagacactactgcctccagagaaggaaagaaattttgttagaatattataaaagggtggcatgtaaaggtagctagactgccttatctccatttcttctcagtgtcagaaaactctcaaactaaaatggaaataagttgctgattcactttaaaacccaaacttacttaaaataaactgtcagttctaagctgagatttactccaatagaatattcccttgatgggttgagaatgaataagatgaattatctgagtcctgatcttgctcatatagctgtttctttaaggaccaacatttggttcctataccgtaggattctctccctggtaaagaggagttagtaatatccatatctcttttctaaattccagaattcttcaatttgtattttctttaactctgtgacctagccgttgtccacggcacagttagtctgtgggtcaaatgggtgtggtttcacctaattctcccagaacgggagatattgcaggaaaatgagtcctactacaatgaacattaaagaaaagattatgtctaaaggcaacattttcatataagttttttcccatatctattaattgcatcaaggtatgtgtctgtaccaacgtatgctgttggacctttctgttagaggtgcttaattggtttctgaccatgtcagttataagatagagaatctgtctgtggtaaatgacatcccataaatgagtttcataaggcttgacctgggagctgacatgtcaggacttcctagtgtgtctttgcataccggttctaaatctcccagcttctttggtatctttttattgtatgacaagatgctgtactttagttcatgtttgaagcgacagaagcttaagttttgagttcccaggaaaagaaagacttaaacatttccaattaaagcatcagagattagtctgactagggtgtgagttaacaggaactctttattgacctaaaaacctacccagaaagtattggcatgagaatttggcagcttggagtgggagggcctatggctatggtcagtcttaacatgttaggacatcttaaatttcactttaaaatttctgagtttgctgttgattgatgcctgctaagaaagcgtttctataataggaattgagattgtgctgctgtaatgccctcaagcaatgccacgtcaccagtatctcctcctattttagggcaattctttttcttaaaccaaattcccagcttcagcaagaagaatccaaaagccgaactgttagaaatttgtccctggtttttccttcctttacccaatttattgagtagctactatgtactaagaagcatggtgttaagaagtgggaatacaaagaaaagtctaaatggccagcaaatgaacaaagagatcttcaactaaaccagtacttaaggaaataaaattaaagcagcagttagagtgagtacgtactatgtaccaggatacaataacaaatcatatttatttacttacacacatacacacctgtgtgcatcaggtgataataaatactatggataaaataggaaatggggataggaacagtatgggaggcagagttttgcagcctggtcttcactgccaccagtgcatgaggctaggtgtggaggatcattgcagatcacatggagtgcctgggctctgtcgccatggttatgtagagatgggacatggaagcgaaaggaaacctttcctttccatattaactctctgactccacattaatgtggatcctgtcctggcagtgtcagcctcaggtctaatttgaaaggtttactgtctataataataatgggctggaagccagttcacatctgactacatgtgtggccacatacatgtatgtgtatttgggaagagaaaatgtatctttagaacttactactggaaacattaggaaagagccttttttctacatgtggagaagaaaagcctttttttattattatgcgttaatactctttttttctccaacctctgtctcctcaaacagacaaataatttaaacatggctgtcaaaatttctgaacaccaggaggatgcctccctgccttccctccctccttccctctatttctgtctctctctttctgtctctctcacacagaaccatagtttcagatcagattttctacacactgttttaatttattagaagggaaaaattctttcttatggctaaaagtttgcactcttgatttttctaaagtccacttttatgactaagctataaatctctaaaaatagagatttacagtggaaatgtcaactcctttgtattatgtcaggtcaaaatgtgtagctaattggtgtgcatttgttcatgcatatgtcatgagccagaactatgttttagcccagtgaccacacatgggggcagataggtgtggtccagttcagatatactaatgttttctttgtttatggtaaattagaatagtgcaaggtactggtttggaaaaatatgtgggcaaggcagacatttaggatttatgaacctttacttagccagtattgccctatcattcgtccaccatatcgacctgtatccactaggggacataagaacacctactggaggaaagaatgaaagtttgtctgcattaaaatttaaacacaggactcttagataacatacaaaaagactcatttttttagtttcatgattcataaagaagttatatattttgtttaaattttaatcatcaccagaaacttttaaaggcaggatcagtatcttaacgtctatttatggaatgagaaccaaacaagcagctaactagcaagcttgtgtcattaactgactacctatgtggtctacagaagctatgctgagaatgattctggctttacaaaatactttatatagaaaaggattaccttttagagtcaggaggtgagacatctggggaggacatctgctatcagattgcagtggacaaaaaccagaagtgttctatattttgcaccccggccactagctatgaaacccgagagacagatgttaagggcactgctgttgtcttctaaactgattatctggcctaccaggttagaaacttaggttgtattttttacttatggttctttttttttttcggtatgatctacctgcagaaaaaaatgcaaagattttaagtgatacagtctttatagacaatttttgctttttagttggagtttttactaacatttaatataagtattaatataactgaattaaggtctacagttttgctgtttgctttgtttgtcccatctgctttttgatcatttcttgttccttttctgccttattttggcagaaaatcaaatcatttttagtttttcattttaattctgttgacttttcagctatacttctttgcattttttttaaagtggttactctagggattataatacacagtcatatcttctcagtcaacagtggttaatattttaccacctcacctccttctttgtgctatatatatatgcatatatatatatatgcattcatcaattgttttatatatatatatatatatgtcctagaataccatgttttactttttgctttctggttttatgtcttttaagtaaaattagaataaacacgcacaattttatatttacccatatattttccagctggtgtcaatttcctttagtctgcaaaattccctttaaaatttttttgtagtgtaggtctgctggcaatgagatctcatttatctaaaaatcccttttccgttatctttaaagatatagaatttgaggttgacaagtggttgtggtgtgtgtatgtgtgtgtgcagcactttaaagataccgtttcattgtctcctggcctctgttgtttctgataaaaagttaaccattactcatattgttgttcctccatatataacatgtacattctctctggctactttgacaattttccctttatctttgttttccagcagtttgaccataaagtttctaggtatagttttctttgtttttgtccttcttagggttcactgagcttcttgcatctttacattatgttatgtttttgaaaaaattggggaaagttttgttactacttcaaatatttatctgccctattctctctttccctctcaggactccagttacatatagttgtgcattgtgatcttgtcccacagttcattaaggttcttttataccccccatcctcgcctctccttctttttttatttctggtcttcagataggataatttctgcatatctctcttcgtgttcactgatttatttatttttctactccaatctgctgttaagcccattcaataattttatttcagatgctgtatttctttattctttgtttattaaagctttaattcctttactgctgtttaccatctattcattgatttgggaccatatttgcctttaagtcctggagccactttaaagttcttgtctgctgtttccaacatctgggtcatcctagtttggtttctgctggataagttgacccattattctgttattggtcacatgtgcctgcatttttgtatgtctagctagttttattacatggtggatattgtggatgctctgtgttgttgaaaatacaaattttgttgtcttcctttaaagagtattgaattttcttctggtaatcagataattaactctcagatcagactatcagatcagaatgaatcatatagggatttttttcaagacttatttttaaagcagttttaggttcgcaacagagcaaaaactacagagagttaccatataaatcttcctgccacatatgcacagccccctccagtctcaacattctgcaccagaatggcacatttgttacaattgatgaatgcatatcattatcagtcaaagttaatagtttacattatggtataatgttacacattatgggtttagacaaacagataataacctatattcactatttatagtatcataaagacactaaattttaacaaaatccatatcaattatttctattatgaattgtgcctttattgttgtatctaaaaaagtcattgccatatccaagtttagttagattttctcctatgttattgcctagttttatggtttcatgttttacatttaggtctatgattcattttgatgtgagtttgtttcattttttgtctttgtttttgagacagagtcttagtctatcgcccagattgtagtgcagtggcacgatcttggttcactgcaacctccgcctcctgagctcaggtgatcttcccatctcaggctcctgagtagctgggaatatcaacatgtaccaccatgtctgtcttatgattcattttgatttacttttgttaagggtgtaagatctgtgtctacattcattattttgcaagttgatgtccagttgttccagcaccacctgttgcaaagataccttttctccattgtattgcctttgctcttttgtcaaagatcagttgactctatgtatatgggtcttttggtgctttctattccattgatctatttgtctttttttttttttttttaaaccaatactgcagtgtcttgattactatgcttagtgtagtatgtcttaaaagttagatagtgtcagttctttgacttcattctcttttaatactgtgttggctgttctgggtctaattagctctctatataaactttagaattttaattgggattgtgttgaatctatagatgggaagaactgacatcttgacagtattgagtcatcctacccacatacatgaaatatctctcctcttagttctttgatttctatcaatagagtattgtagttttcttcttatagatcttatacatatcttattagatttatactttaagcttttggagggtgctaatgtaaatgtactgtgtttttaattttaaataccacttatttattgctggcatataggaaaacagtttacttttgtatattaaccttgtgtcctacaaccttgctgtgatcacgtattagttccaggagttttttaatcaattcttttgaattttctacatagacgatcatattatctgtgaacaaagagttttctttctttcctcatgataaggttaggccttgtgtccccacccaaatctcatcatgaattgtaatcatcaggtcttgagggagagacctggtgagaggtgattggatcatgggggtggtttcccctatgctgttctcctcatagtgagtaaattctaacaagatctgatggttttataaatggtagtttttcctgcacttagacacacactctctctcacctgccaccatgtaagtcatgcctgcttccccttctatcatgattgtaagtttcctgaggcctccccagccatgtggaactgtgagtcagttaaacctctttccttcataaattacccagtcataggaagttctttatagcggtgtgaaaatggactaatacacctcacaatcttatataacttttcttttcttactgcattaggtggtacttccagtatgatgttgagtggtggtaagaagggacatccttgtcttgtttctgatcttagtgggaaatattctggtttcttaccattaaatgttatgttagctgtagggtttttgtagatgtttttaatcaccttgaggatgtttcccgtttgttcttagtttattgagaatttttatcatgaatgagtgttagttagattttgtcaagtgctttttctgcagctaggactatgtgattttttttttcttttttagcttgttgatgtgatagattccattaattgattttttgaatgttgaaccagacttgcatacctgagatatattatatttggctatggtgtataattcttcttatagattgttagacttgatttcctagcttttttgagaatttttgcatctgtgttcatgagaaatactgatctgtcattttcttgtaatgtctttgtctggttttggaattaaggttatgctggtttcatagaattatttaggaagtattccctccgcttctattttctggaaaagattatagagaattggtataatttcttccttaaatgtttgatagaattcatcagtgaacccatctgagtaaggattattttttaaaattttgttagggtgggggtagtgtaatcctttctccaggactagaatagctcacttctacccctttctgggtatcagcagagtatccggggtgttcaacgaggtctcttcagtatgattggtaggacgtcctatgtctcccagctttgtgtaatctcaggaatctctgggtagctgccaactcacaggcagctgttttttttttttgttttttttttttcccctggccttgtgttgtcttgtcttggtgccctgggtatgtgcagcttagtatttagctaaatgcttaagatgtcacttatatgagtaactggaatactgctcttcagagcttcattctctctgatatcatactcttaaaaccttcaggaatcccaacctccagtctgtttctccagctcagtaagattactatgtcctgcttgggttacctcctggtgccacagtctagaaagtgttctcagacagaaagctggggcaattttgaggcttattctatgtagtttccctctccctggaatcatagtcctgcagctgtctaaaattggttgccatatattcactattcacaatagcaaagacttggaaccaacccagatgtccatcagtgatagactggataaagaaaatgtggcacatatacgccatggaatactaagcatccataaaaaaggatgagttcatgtcctttgtagggacatggatgaagctggaaaccatcattctgagcaaacctatcgcaaggacagaaaaccaaacactgcacatgttctcagtcataggtgggaattgaacgatgagaacacgtggacacagggcggggaacatcacacaccggggcctgtcgtggggtggggggagcggggagggatagcattaggagaaatacctaatgtaaatgacgagtgaatgggtgcagcaaaccaacatgacacatgtatacatgtgtaacaaacctgcacattgtgcacatgtgcccaagaacttaaagtataattaaaaaaaaaaagaaaaaaaatgcaaataggcaagaaaggcttgattctggagcatatcagatttcagatcttgctgacataaacacctctgggccaaaagtttaagtcaactggagacccttgacattctaattgagagttagccctgcaaaggaggtgattgattaaattgattctaacacataattgattgtataggaaatctgagaacattgaccctttaaaaatttatgaaattattatctgtttttagaggtaggagatccttgacagaataaactgactttatttctctgcaaaaaaaaattgtttgccaaatgttaaggtgcacatatgtaagccaagatccaatgagggctgggacagaaaagctgctaaagatttgtgaggtgaatggagattccaggggttacacagtgtcttgggaacataagaattgaggccatccagaatggggagacctcactgaacaacatgggcactcatttgatacccgagaaggtccatgacttgagtaaggctattgaagccctggaatgttgggttttaaaaattagtttacatttgtcttgtgcagaacaaataagacaatcattgtcccaaggatccttctgtcaagttggcttgataattgataataggttcatgcaaatctgatgcttaaatactgagttagcagtaaaggaatcttcagcgtaccttccatatgctttatcagaggaggaggatttgcaaagagaatgtcttcctgtttatttttttccctcttatgaccactggccatgcttcaatctgtgtttctggatctggaaaaaatccttccagtgctgatgccctttgccatcttaatcccagagccttataggcacaatgaattatttattttacaagtttatgcatctacaaaataaaaatcttctgatgtttgaagtatgtatttttaaaagaatgtgcttatgaaaatatctttttcaaagtcttcttccaatattatttgttctatgtacttgtctgtgatcaggagctagaacacataggtttttaaatagctaactaaagcatttctttagtgctgaacattgtctttaacgggagtatataaagacctcttgtttaccggatttgattaattggaggaggagctttcttaagcacacactgttttctcaaatgtttcccagcctcctgtcagttctgtctgtcatgggtcattcagcacacactcgtttggatgactcttaaaaactgtcacatgtcaatcaaaggaaaggagatgcaaaatgaagaagtaaacttgcttcatttgaaattgaatagactgttcctgtaaagctttttttttcctgggttaagcttaaatttattttttttaatttgacaaataacattgtatatgtttgtcacatacagcatgacgttttgaggtgcacatacattgtgaaatgattaactcttgctaattaacaaatgtattacctcacacagttatttttgtgatgggtgcactcagcatccactctctttgtatttttaaggaattcagtatatcctcatttaccctagtgaccgagcacctgtaaagcttttttgcatctttggttttctagctacattttgtattttggcagtactaaggggcaggaagagacatgagtggatgatggtcgctgagtaaaataaagacttaagaatattgcactaggaatccactttgggaaaaacttcaagtttagtatggggaatgtaaagtgaaattttgttgttctagaaactgtagtccacagtgtttcatctggaaggactttaaaaaaataatagttgttagatacttttcgtccttcagggcaaaataaaacacagcagtttgaggaggtttttcagaagtttgtggtagagtaataaagttttattttttgagaattctgaccttagaacaaaagctgactagcataaatgatcacttatattcctttgtaaaaatctcataaattttaataaaaatataatgtcccaggatttccttgaattcgaaagagagactgtttaagtaacttgccccaaaaattcagagttgggtaacttctatttaaaaatggaacagtccatttttcctggcatgaagtccttagggattattggcactgttagccctcaggccctcttgcttcttgtaccagttactgccagtagagtgatgtgtcacaactcagctttcagcaaatctaaatggagcttcttaaagacatggaatacatatgattttttctatactttcaacacatagcccaacttgcacagtgtctggtacaaaatagttgcttagaaatgttcttagaatagcaaatgaatgcctctgctttaatgtcaaagacattattatggaaacagtatgggattttgttcagtattccttccaccaaatagatatgatttttagttttagaaaatagtgttggccaggcgcagtggctcacacctgtaatcccagcactttgggaggctgaggtgggcggatcacctgaggtcgggagttcaagaccagcctgaccaatatggagaaaccacgtctgtactaaaaatacaacattagctgcgcgtggtggcacatgcctgtaatcccagctactcaggaggctgaggcgggagaaccacttgaacctgggaggcggaggttgttgtgagccaagatcgtgccgttgcactccagcctgggcgacagggtgagacaccatctcaataaataaataaataaataaataaataaataaataaataaatacttttaactctttagtactttcctaagcaaaaaattggggaagaatgtaagcaaagtttatatttacagctgacctgacggcagcgtttacagaagtttctattacataaatagctgctagaagagtttttaaaacttctaaattcagtgagttaacttggaccttttttcttgtaggatgttttggtgaaataactggtctactggtttgtttttgttttttttctattatactttaagttctgggatacatgtacagcacatgcaggtttgatacataggtatacacgtgccatagtggttcgctgcacccatcaacccatcatccacattaggtatttctcctaatgctatccctcccctagccttccaccccctgacaggccccagtgtgtgtgatgttcccctccctttgtccatgtgttctcattgttcaactcccatttatgagtgagaacatgtggtgtttggttttctgttcctttgttagtttgctgagaatgatggcttccagcttcatatccctgcaaaggacatgaactcattcttttttatggcagcataatattccatggtgccacattttctttatccagtctatcattgatgggcatttgggttggttccaagtctttgctattgtgaatagtgctgcaataaacatacgtgtgcatgtgtctttatagtagtctctgagtatatacccagtaatgggattgctgggtcaaatggtgtttctggttctagatccttgaggaatcaccacactgtcttccacaatggttgaactaatttacactcccaccaacagcgttaaagtgttccaaaaagtgttccagtttctccacatcctctccagcatctgttgtttcctgactttttaatgatcgccattctaactagcgtgagattgtatctcattgtggttttgattgtgtttctctaatgaccagtgatgatgagctttttttcatgtttgttggccgcataaatgtcttcttttgagaagtgtctgtttatatccttcacccactttttgatggggtggtttttttcttgtaaatttgtttaagttcgttgtagattctggatattagccctttgtcagatggatagattgcaaaatttttctcccattctataggttgcctgttaagtctaatgatagtttcttttcctgtgcagaagctctttagtttagttagatcccatttgccaatttttgcttttgttgccattgcttttggtgttttagtcatgaagtctttgcccatgcctatgtcctgaatggtatcgcctaggttttcttttagggttgttatggttttaggtcttatgtttaagtctttaatccatcttgagttaatttttgtataagatgtaaggaaggggtccagtttcagttttctgcatatggctagccagttttcccaacaccatttattaaataggaaatcctttccccattgcttgtttttgtcagatttgtcaaagaacagatggttgtagatgtgtgacgttattgctgagggttcttttttgttccattggtctatatatttgttttggtaccagtaccatgctgttttggttactatagtcttgtagtatagtttgaagtcaggtagcgtgatgcctccagctttgttctttttgcttaggattattttggccatatgggctcttttttggttccatatgaaatttaaagtagtttttttctaattttgtgaagaaagtcagtggtagcttgatgggggggatagcattgaatctataaattacttagggcagtatggccattttcacaatattgattcctcctatccatgagcatggaatgtttttttctgtttgtttgtgtcctgtcttttttccttgcgcagtggtttgtagttctccttgaagaggtccttcacatcccttgtaagttgtatttctaggtattttaatctctttgtagcaattgtgaatgggagttcactcataatttggctctctgtctattattggtgtataggagtgcctgtgatttttgcacattgattttgtgtcctgagactttgctgaagttgcttatcagcttaaggagattttgggctgagacgatggggtgttctaaatatacagtcatgtcatctgcaaacagagacaatttgatttcctctcttcctatttgaataccctttatttctttctcttgcctgattgccgtggccagaacttccaatactatgttgaataggagtggtgagagagggcatccttgtcttgtgctggttttcaaagggaacgtttccaggttttgcccattcagtatgatattggctgtgtgtcataaacagctcttattattttgagatacgttgcataaatacctagtttattaagagtttttagcatgaaggggtgttgaattttatcaaaggccttttctgcatctattgagataatcatgtagtttttgttattggttctgtttatgtgatggattacgtttagtaatttgtgtatgttgaatcagccttgcatcccagagatgaagccaacttgatctcggtggataagctttttgatgtactgttggaatcagtttgccagtattttattcaggatttttgcatcgatgttcatcaggaatattggcctgaaattttctttttttgttgtttctgccaggttttggtatcaggatgatgctggcctcattaaatgagttagggaggagtccgtctttttctgttgtttggaatggtttcagaaggaatggtactgcctcctctttgtacctctggtggaattcaactgcaaattcttcaggtcctgggcttttttggttggtaggctattaattactagctcaatttcagaacttgttattggtctattcagggattcgactttttcctggtgtagtcttgggtgggtatatgtgtccagcaatttatccatttcttctggattttctagtttatttgcgtaaaggtgtttatagtattctctgatgatagtttgtatttctgtgggatcagtggtgatatcccctttatcattttttattatgtctgtttgattcttctctctgttcttctttattagcagtctattttgttaatcttttcagaaaaccagctcctggattcttttggagagttttttgtatctgtatctccttcagttctggtctgatcttaagttatttcttgtcttctgctagcttttgaatttgtttgctcttgcttctctagttcttttaattgtgatattagagtgtcaattttagatctttcccactttcccctgtgggcatttagtgctgtaaatttccttttaaatgctgctttagctgtgtcccagagattctggtacattgtgtctttgttcttattggtttcaaagaacttatttatttatttatgtatttatttatttatttatttatttatttttttgagacggagtctcgttctgtcgccgaggctggaggtgcagtggcgcagtctcggctcactgcaagctccgcctcccgggttcacgccattctcctacctcagcctcccgagtagctgggactacaggcgcttgccaccacgcccagctaacttttttgtctttttagtagagacagggtttcactgtgttagccagggtggtctggatctcctgacctcgtgatccgcccgcctcggcctcccaaagtgctgggattacaggcgtgagtttatttctgccttaatttcgttatttatccagtagtcattcaggagcgggttgttcagtttccatgtagttgtgtggttttgagtgagtttcttaatcctgagttctaattttattgcactgtagtctgagagactgtttgttatgatttctgttctttagtatttgctgaggagcgttttacttccaactatgtggtcaattttagaataagtgcgatgtggtgctgagaagaatgtatattctgttgatttgtagtggagagttctgtagatgtctattaggtctgcttggtccagagctgagttcaagtcctgaatacccttgttaattttctgtctcattcatctgtctgatattgacagtggggttttaaagtcttccgctattattgtgtgggagtctaagtttctttgtaggtctctaagaacttgctttatgaatctgggtgcagctgtattgggtattgtgtatgttgaaccaggcttgcatcccagagatgaagccaacttgatctcagtggataatctttttgatgtactgctggaatcggtttgccagtattttattcaggattttcgcattgatgttcatcagggatattggcctgaaattttctttttttgttgtgtttctgccaggttttggtatcaggatgatgctggcctcattaaatgaattagggaggagtccctctatttaggatagttagctcttcttgttgcaatgatccctttaccattttgtaattcccttctttgtctttttttatctttgttggtttaaagtctgttttattagagactaggattgcaacccctgcttatttttcctttccatttgcttgataaatattcctccatccctttattttgagcctgtgtgtgtctttgcacatggtatgggtctcctgaatacagcacactgatgggtcttgactctatccaatttgccagtctgtgtcttttatttggggcatttagcacatttacatttaaggttaatatcctttcttccacctgatcgattcggctattgatactgtgtacacttcatgaagttcttgtgcggtgtttttcagcttcatcaggtcatttatgttcttctctaaactggttagagactaggattgcaacccctgcttatttttcctttagttagcaattcctctaaccttttttcagggttcttagtttccttgtattgggttagaacatgcctctttagctcggagtagtttgttattacccactttctgaagcctacttctgtcaatttcatcaaattaattctccatccagttttattcccttgctggcgaggagttgtgatcctttagaggagaagaggcattctggtttttggaattttcagcctttttgtgctggtttttcctcatctttgtggatttatctacctttggtctttgatgttggtgaccttcggatggggattttgtgtggacgtcctttttgttgatgttgatgctattcctttctgtttgttagttttccttctaataggcccctctgctgcaggtcttctggagtttgctgggggtccactccagaccctgtttgcctgggtatcaccagtggaggctgcagaacagcaaagattgctgccttttccttcctctggaagctttgtcctagaggggcacccgccagatgccagctggagctctcctgtatgagatgtctatcgactcctgctgggaggtgtctcccagtcaggaggcatgggggtcaggaacccacttgaggaggcagtctgtcccttagcagagctctagtgctgtgctgggagatccactgctttcttcagatccagcaggcaagaacgtttaagtctgctgaagctgcgcccacagccacgccttccgccaggtgctctgtcccagggagatgggagttttatctataagcccctgactgggcctgctgcctttctttcagagatgccctgcccagaggggaggaatctagagaggcagtctggctacagtggctttgcagagctgctgtgggctccatctagttcaaacttcactgcagctttatttacactgtgaagggaaaaccgcctactcaagcctcagtaatgatgggtgcctctccccccaccaagctctagcatcccaggttgacttcagactgctgtgctggcagtgagaatttcaatccagtggatcttagcttgctgagctccatggggttgggatctgctgagctagaccacttggctccctggctccagccccctttccaggagagtgaatggttctgtctcactggcattccagacaccactgaggtatgaaaaaaaaaactcctgcagctagctcagtgttgcccaaatggccgcccagttttgtgcttgaaacccagggccctgatggtgtaggcacccaagggaatctcctggtctgcgggttgcaaagaccacgggaaaagcgtagtatttggggcagagtgtaccattcctcacagcacagtccctcacagcacggtccctcacagcttcccttggctaggggagggagggagttccctgactccttgtgctttctgagtgagttccctgactccttgcgctttccaccctgcttctgcttgccctccgtgggctgtacccactgtctaaccagtcccaatgagatgagccaggtacctcagttggaaatgcagaatcacccaccttctgcattgatctcgctggaagctgcagactggagttgttcctattcggccatcttgccagccaccccctactgtgtgatttttaatggcatcagaatagttcattgtagggctgttccataatttatttgtacaagtcacctctatgtggatatttagattgtacacatatacacacccctttgtgcaagtgtcttgctatttccttagaaaaaatcttatatatgaagatactgcataaagtcatatgtacatgttttagaattgttgtgaggattcagttacgtgctattataaagctttacaacaatgcctgacagtaaaatctcaaggagttttgatagtatggtgatagttttcattgtctcagtcttgccgcttgactttgagcccctaaataaggtgactgcttcaattggaaaaacatcagagatccttactcaaagtggcctgaacaataaggaaatttctgattcttgattaaatgataaagagattttattacaggatgctcaggggggctaagtacagaactcgttaattcagaagctcaagagtatcaatgaagaaacagtctctcaatgtatgttacctgccattctcgctaagttagcttttcttcaagctagtgccatcccatgatacagtgcttactgagagtcatacttgaatcaaaagaagaaaaggctagttctctctcactctatttaagggcagtgaagtctttttctgaagtacctagcagatttaccctcacatttcatttgccattattgaataaatagaatgggaccaccatgattagcttagaccattgtttttcataccttttgattttgacacactaggaaatacattttacttcgtcatgacgagggcacttatcacacatcacttctgtttgggtatatgtatgtctgtcttatacaattaaatgtaattcaaaataagtttctcaaaataatgcttatctttactactgattgtaagttaaatgctattttacttatgtttaaataggtttttaatacctaaatacaaaaatttagaacagatttaacttaatgtatagatatgggctgttcatgaatttttttcagtctggaatacatgaggacaatgctatgagcatatatagtacatggttgagccgttttttcaaattttgggtcaagattaaaaatacctttttacacaaacaggtcattgtgagtagcaaaataatcttaataataatttattcagatgagattcatcaatgaattctgtacttagtaggaggggattacacaagtgtatcaataccaggatttgaggatcattgggaaccatcttggaagctgcctagcacaaagtatgaggcaactaaatgcagtatgtcatcctaggttgaattatggattgggaagaaaatgctgtgaagaaaaattgagaaaattgatgatttgagcatgggttgaatgttaggtaatattattacatcagtatgttttctaattttaataattgtattatggatatgtaagtcaatgtttttgttatttggaactatacgctgaagtatttatgtgaaggaagggtaataaagttttagtactattcttgcatgccttctctaaatttgaaattatttcaaagttaaaatttaaaaatgtcaagagagattgttttaaaatgaaaacaatgtgagtctggttcttaagttcatacatactgaatacattatatgtatgtcgtgtatgtcaatccttttaataggctgttggatttagtttattagtattttgttgaggatttttgaactggtattcataggaaatcagttcaaatgtaggtttctttcttcttgaggtatctttggctttggtatcagggtaatgctggcctcatagaataggtaagaagtattggctcctcttctgtttttttaaagagtttgagaaggattggtgttcttcaaatgtttggtagaattcaccaatgaaactgtatggttctgaacttttttttgttgggagagttttgattacttattgactgtacttataggtttgttcagattttatatttcttcttgagtcagttttggcaatgttggtgttcttagtaatttgtccattttttattctcctaccatgtatctggtttaatgtatatggaacaataatgtgtttttgcattgtgtaaacacatctgatttaattttatgtgaagttacatttaaaccatataaaataaatcctccattaaactgccttgccttgcatatctaacctaaaatgcatttatcacttgagcattccatttgcttcacattcacatcaatatttgttattttccattgttttcattttagccctgtggtaggggtgttccaagtgattttgttttttaagtttgaagttttatttcaacactgtcatctacaagaatatcattaccaacaacacatctggggtccgtcatttttattgttttgcacatttataaaaccatgttttaaatcaagcttattttaaagtcgtatggttattattttctatataaaatgtggctcaagtcaagtcagagattactgattggagtcaacattttctctcaattttgtcactatcaacacttccaaatctggtagttgggcttgcctctgtaggttttacttcactgtctttttttcttctgagtatagagtgattcattttaaggactgcttatactaaatcagttaaaatattacagttgctgagaatttgaaaaattttatactcaataacattctttctgaaaaatacactgaaagtttttaactaaacttggttgaaagaatcagctctttgccgatagataaacttctcacatgctttgcttttaactctgcagagttactctttaacctcttcattatcgtcaaattgaccatccatgtcagaagatcaaatgagttatcagtgaaccaaatacctattcctgaccaatttatgttgtattcctctcacatgatagtctcaattggctgcattgttcattctattgttcattcgatgttaagggtatatacaatatgctgtatgtggtttattctattcctttatttttttatgccggtggcaaatcactgatttaattttatgatccactaattgatcataaccctcagtttgaaaaacatggattttaaccagtcaccattgtctgtgggaggtgggaccagcttttccaaagcatatggccttgcagaaatgggataaatgctagacacacggtcaggcttctgtttgaaaggaggagaaggggttgacaactagaggttaggataggcaaccaaaataatctgctgcagagactgtcgcttactcatttagctgtcctaagcatctgatgtgctaggaagtactgtatcaacttgtttcccttattctaatggctcttaacgattattcttcctttttccggtttgtttgtagttttgtgttcctcagatattttttcttgttgctatcattgtgcttgcctttacattgccatactatctcctacccacccattttaaaaagttcccttttcattttgctgcttttcatctgcttagacaaaagactagcttcttaaaagctgtggctcagagtaaccaagttctcagtaagatctaaggttttactttacgatctttttcatggtgatatttgcttattagatttttaaaatgacatccaaaatttttagctgcggcctggctagttaccaataagttatctctgaaatacagaagtgctcctgtacccttcagtcttccagaacaaaagcttctgctgttattaaatggtaataatgtaatcacaatacttggggactctactagattatattccttgttttccttgatgttgggtaaagagaagtctcctgtcccacagatcattaattttagaattatgagtaatagcgaatgtattcattgttgtaacctagcttcagttagtcaacaaatactttaaaatattgcatttcatcaattgtaagatgctcattttctgactttttttttttttttttttttttttttttttttttgtttgagacggagtctcacaccgtcacccaggctggagtgcagtggcacgatctacgctcactgcaagctccacctcctgggttcatgccattctcctgcctcagcttctggagtagctgggactacaggtgtccgccacggcgcacggctaattttttgtatttttagtagagacagggtttcaccgtgttagccagaatggtgtcgatcttctgagctcgtgatccgcccacctcggcctcccaaagtgctgagattacaggcgtgagccaccacgcctggccattttctgacattttaatacctctgaaatcagaatgcagcttacatttaatggtgtcctacagttgctgttgtccctgtggtaaatcatggtgtagtttccacatgaacttggttgctaatcctagagacatgactgaactgcacacctttcactgttttagttaacaaaccattgaataataaaccatttaaggacctttcagaaaaggagttttgtcactgtccaaaatgtcttctgttaataacctctgttaagattcagatagtgctaccaccaacatggcacatgtatacatatgtaacaaacctgcacgttgtgcacatgtaccctagaacaacttaaagtataataataagaataaaataaaataaaaagattaagatagtgctactatcatcaaagcttctaagaatgtgcatctgaagcttgaaagtcccagagacaacagaggattactcttttaagaaatgctgcgttatcaaggatcttgttagtataaaaaacaatactgcatggaaaaccttgacacctatgattttgaatataaaagtgatcagaagagttgaacactgaatgtgaagaaattttaggaatagcttagccagtttagattgcttatattttcttatttgtacatgatatatggttcttacggtttctaaataagtctaaagagctctttcaatatttaacaaataaataaaaaatgtaagcagtaagaaagcatgtgtcatggtttaattgactattttcttccttagtggtatataaaatggtgcttcatataaacagtactgtcttcaatttgatgaaacgagtttgatttactgtcttactgttattttactgcttcctattataacatgttttcttctccataacactataaggccgtgcatgaatgttagagactatgtctcattgtgatctagcagccacagtatcatccgggaacttgttagaatgcaaattcttagaccccaccctagacctactgaatcaggaatctggatgtgggtgtgttaccaagccatacaggtgattttaatgcaagcttaagtttgagaaccactgctctgggcacaatttcaggcaagggaaaaatactggtactgttatattcaaattaggtatatatgcatagcttaaaagagtaagaagccacagatgccttgactttagcttaattctgctaacagtgtgtctaagaggaatgaagaaatttaccatggtgtgtgttagctaaccaccagtaatataggcagagtaatggaatagtccaagaactacatctccttcactgttaatatttgatctttgtcttttcagcatgacgtatcccagactttactcaaggcaacactggacagtgttgtagaagaatgtgtcagctttgtgggagtggatattaacatctgttcagaagttttgttaaggtgagacaaatatgtggctgaagatcacagaatcttgagtttaactggctgtccagtccaaactcggctagaagaagggaacacgtgtataaagttgtcaagtagagaacgtctatgggtttatacattgctttaagtaatcagaggggaagacatcatttaagaaaagaattataacaattcacattatcatttttaatattgcaggtctaaagtgaagagcatatggtaaccattgagtgtattagtgttgctaatagaatttaaataaggttaacatggaaaagagctgtttcccaccacgtgagagtagagatttttcactagttaagcctcttgcatgcatctgtcaaacctggcagtaaccaaaagataaattctgagggttcaaggtatggttaccatatttttaccctgattccacaagaaacctgtcaaaatttttatcatactataatcgcatgttatataatcttcttttcccccatggttttagaagagctgcttttttgttcacagttttgcatttattacacaagtctgctaatgcagcatgaaattccctgatctggaccgttttcactgaaacaggtatagcagaaactgtcccttacattttaagttgttgattttctaacacatctacaaacatttcataatttcatatatggaattttataatagagttgagattctctgaaataatcttttgacaccaagcaaactacctaatgatatagtctttgtatataatttatactaaccatgacaattatagataagggcctttctgtagttcagctctatattactgagaacaggctaacacacaaaaaaggtagtacaacacagttgtagctattataacttcttctaactcactttgtatgtatgctgaaaaaaataggcaaaattattactttatccagaaacataaggaatgtgaatagtatagaaaaactaaggaacatttttttcttgcatcagtgttagccttcttaccagcatctttatgacagctgttggttttgtcattatttttttattctgttgtccttctttcctcttgcacaactctttttttctccgttttttttttgtttttttttttaaactcccttttggattaacttaacttagccgtatgaggatatgtcattgcagtcgtttttatgatccaaatgttttatatcattgtcttttcagatgagatctttttttcagtttgcttattttttttttctaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcaggtgagtataagtatacactttgattctattgtcaacctcctctcttgttactgttacctatcctaccactgattagtgtaaaattttctaagtgtccattgttcatgccttcattcagttaagtgttgagtgactgtcctttggtaggcattgggaatacaacagtgagcaagtcagcaaattccggattctcatggagttatattttaacatgtgacacagacaataagcaaactagtaaaattagtactttcagatggcaagaagtgctataaaaattaaagcagggatatgtgacactgtcttaggagagtaatacaactactttagattcgttattttttgaaaacttatttgagcagagttttgaatgaaatgccatccaaggatcagaaagagagcattccaggcaaagtgaacactaagtgtgcacagtcctaaggcaggaccaactttggtgtattcaggaaatgaggcaaaggcccacacaattagggcatagcaaatgggaaggactggtacaagatgaggtgacaatggtgacttcaaaatgaccactttatactgacatagctgttccctaagcatagatatgtttccccactccctcctcactgaaaatggaccaaagcattgattatcagttgtgtggatcaagagctaaatttctttattttctaatcctgaaagcacaaaagcttgttagataaacttcttagcatgatataatcatgaaagaagaacatttacgtatctgctactttgggactacgtggttaattcatatggactttataattttgacaaaattataatagaggtcatatggaagataacctttcttctggaaaagactgattaagcctcactagaatacattataaagctgtggaaattaaacagtttgcttttgatgtaggaatagcacagaataaggtctgaaatccaccaaaacatggttagaatttagtttgtggtaaaggtgacatttcaaatggtagggtaaaattgattaattatctaacaaatgatattatgacaactgccagtaattcaatatgtgtgaaggaagctgtagtcccacttctcactcctatacccagataaattacagatttatcatagacttaaatgtcaaaaaaagtaaaaaactgtaaaagcaccagaagaaaacatggggaaatcttgcagagcattagagtgatggaaattctttctaaatagatcatgaaacctagaagtcacaattgaaaaaaattgaagataaaatgattctgtttttgttagtttatatgttctttgaacacttggttagaaaactcacagcataggccaggagccgtcgttcacctgaggccaggagtttgtgaccagcctggctaacatggtgaaaccccgtctctactaaaaatacaaaaattagctgagcatggtggtgctcacctgtaatcccagctacccaggaggctgagacaggagaattgcctgaacccaggaggtggaggttgcagtgagccgagatcatgccgctgcactccagcctgggcgacagaacaagatcctatctgtctcaaaaacaagcaaaccaaaaaaacaccaaaaaactcacagtataaaaaaagaacaaaaagtaaaagatgcctctcaagtctcacttgaaaaagtttcttatatgttgcttccagaaagtaaatttacagttatgtcaccttgtatgtatatgtttattattttaaaaatgtatacacaagggatcaggctctgcaactatttgaaacttgctttatttgtttcagtcttctggatctctttccaaattattacatatagatttctaattttttattctttatattgtctgcataaaatttaattgtatggatgggctgtaatttagtctaatcagtgtcttattgatgaagcttattttaaagccttgtacttttccagctgataattaggtacttgaagatttgtgactgttacatctcatgaactataggtttattcagaatggaatattgctaccacatttaatgttttttgctttgaaatttatttgctagcaatgttactgtatatgcctgttttttttaatttttatactttctatgacatttaatttttgatatggctcttagaaacacatagctagattttgtggttttactcaatctgttattaatacattcatatttgttgtatttatttatatgtttgggcttattcttcctacgtattttgcccctccatcatgctttctgattcttcttttccttttacgctatttattagatttatcagttaataagttttctgtttctctccttgttttcccatctcatctttatctctccttagtgatttcaaagttgtacatcttctattcttatgatcatccttaaattggttttggactgacctctggagttaataggtgtctgtcctcttagagaagactagaaacaggatccttcccaatctttctctcttcaactctctctgcctcccatgataagatgatctgggattttagtttcagactcctctcctctcctctcctctcctctcctctcctctcctctcctctcctctcctctcctctcctctcctctcgtctcctctcgtctcctctcctctcctctcctctcctctcctctcctctcctctcctctcccgtcccctcccctcccctcccctcccctcccctcccctcccctccttttctctcactctctctatatattttatacatatataaaaatattttatgtatatttttgttttttaacctatatatacgtatacagactatatgcatgtgtatatacgtgtgtatatacatatacacatacacactatatatacacactcctccatatatataaaatatattcttatagatgtatatttttgttttttaaatgtgtgtatatacacatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtatatacatactatatacacactatatgtgtgtgtatgtacatactatataacactgtgtgtgtacatactatatacacactatatgtgtgtgtacatactatatacacactatattgtgtgtacatactatatacacactatatgtgtgtgtacatactatatacacactatatgtgtgtgtacatactatatacacactatgtgtgtgtgtacatactatatacacactgtgtgtgtgtacatactatatacacactgtgtgtgtgtatatacatactatatacacactatgtgtgtgtgtatatacatactatatacactatgtgtgtatgtgcatactatatacacactatatacacactatgtgtgtacacacactatacacactatgtgtacacacacactatatacacactatgtgtgtacacacactacagacactatgtgtgtacacacactatatacacactatgtgtgtacacacacactatatacacactgtacacacacactatatacacactatacatactacatatatactatatagtgtatatgtatatatgtgtatatacacataatgtatatatatttacatcattcatgagcacttatttaatttaatcagtttttgtggtttctgcactgtttcttgtagttcatatcatcatttttctttgatttattggtttttgctagaattaatccttaagaaattcttttagagcttggtatgggttatacttaagtccttacatacctgcaaatgatttcaatttgccctcctacttgaatgctaatttgactaggtatgcgattctaaattcaaaatcattttctctcagaaactttaagatattgttccactatgttctgacatctgatgtttgccagtgagaaatctgatgctagtctgattccagatccttttaaagtaatgttttaattttctctcttgaaagccttttagaattttaaagattatttatattgtaaagtttatccatgatatgtcaagtatgagtcttttgcttttcttttctttctttttttttgagacagtctctccctctgttgcccaaactggagtgcagtggcaggatctcagctcactgcaaccgccgcctgccaggtttaagtgattctcctgcctcagcctcccaagtagctgggactacaggcaggcatgcaccaccacacccagctaatttttttatttttggtacagacagggtttcatcatgttggccaggctggtctcgaactcctgacctcaggtgatctgcctgcctcggcctcccaaagtgttgggattacaggtgtgagccactgcgcgaagccaagtatgagtctttttctattcatcctgttctacactcaatagattcttttgagagcttgtttttcttagctctgggaaatattattattttgtttccctacattttcctcttttctctcttagaatggcaattatacaatcagttaagaatgtttttggctttaagtaacagaaagcccttttcccagtgatttaaacaaataagtggtagtttctatgaagtaaaaggtcaaaatctggttgctgttttcgcatatttgtatgacagagaagtaagcacattttaatttgaagacttttctgcccaaccttccccttttcataaatgtggttttttctggttttatatagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtaagtctgaggcccatgtgggaattctccatatgcagagtgagttctttacagcaaatggcctttgttttggcataatggaaactgaaaaatatgaccgtttaatgtgacaacatttttcagaagttctgcattgctgagttatgtggcacattatttcatttcactgaggaatgaaaccattactcctggagcattgtcaagctaataaaccctgatactaatggtgaagtgtgtgtaatggaaattgcatggcactcccctctgtttgttttggaaattaacaagacacaattgactagcacctggcataaaacttgtgcttttctaaagataaaacccttttgaaagtaaacaaccaactcagctttcttaatattatctttattggttattaaaatcttaaaatctaagaaatgatgtacttttagtgagtatacattaacagaatgacatgggggaagtttttgagtagaagggaagtttacggtataaaaagaaaaatctttttaacagcatatttaattagctttaaatttttttaattagttcaaaaacagtgacttgctacataacgacattttttaaagattcttactgaattgtatgacagtgtaacaaatatagtgaatattttaacttttattgaatctaaaatgagatttttgttttaaaatcacttatatttgattattttagtaaatgtcattaatttgctttcttttaaaaatatttaaaaagactatagtatattatagaaaacttagaaaaaagaagtaaaaaataatattctgtgaacatccaactagttcctggtttcccccaacagttttatgatgaaaaaatttagccatacagaaaaattggaaaaaaaatttttacagtgaattcctatatagccacacctagatgttatcattaacattttattctatctgtttttccacatatccatctacttatccatccatcttatttttttttgtcttgttttgttttgttttgtttttgagacaagatctctctgtcacccagactggagtgcagtggtgtgatctcggcaacctctgcctcctgggttcaagtgattcttgcgcgtcaacctcctaagtagctggggttacaggtgtgcagcaccacggtctggctaattttttgtatttttagtagagatagagtttcgctgtattgtccaggctggtttcaaactcctggactcaagtgatccacccaccttggcctcccaaagagctgggattacaggcgtgagccactgcacctggcccatcttatgtttttgatgcattccaaagaagattgcagacagacattggtacactttgcactaaatacttaagcattcatataattaactacaatttgataattctttacgatttttttcttttgaggtcacatttacgtaacaattaaattttaagtttatattagctgaattttgacaaatacctacttctgtgtaaccaaactgctgttgagatcaggaacatttctattatctgaaaacgttcccttatacctcttccgatcagttactgccccaacctcccagaggtaactacttgttttgatttttttctaccaaaggttagttttctccctctaccatacaattgtactcatctgtgtaaggcttctttcagcatcgtatttagagatttatccatgttgtagcaagtaccagtagcttattttttattgctcagtaatattccattgtgtgaatataccacagcttatctattttcctgttaatgaaatttaagagatataggaaataccaaacttttttatactgtctactctcagtacaacatagaacactttcgtggcctctggtcaccaaaatatgtagggatttctcccctccaaccagtcaattctgcagcagattatccagcagacgtcacctgggtgtcctctaatttagttaatttctgacactatctacctggagatagtgtcagatcccacaggttgagggctcagaactacaagattgctcccaacttgagaggtctggttgtgacctgtaacttcaggattcctatgaccctggagttcaattaatttgccagtttgcagaactcagggaaacatctacttaatgttcatccacttattataaaggatattacaaaggatacagatgaacagccagatgaagaagatgtatagggaaaggtatagggggaaggtatatgggggaaaggatatggaacttctacatgggcatactaccctctaggaacctccaggtgttgagctatctagaagctcattggaacccaggccttttgggtttttagtaggtttcattacataggcatgattgaatcattggccattagtgatcaactcgaccttcagcccttctcccctccctggaggttgggggtctggagctgaaggtgacaacccctctagtcacttgtttggtttttctggtgaccatcccctatcctgaaggtatctaggggaccccagctaccagtcgtgtcatacaaaagacactcttatctatcactctggagattccaaaggttttaggagctttttgcagggaaacaggaggaaagccagatatgtacttcccaatatcacatgaaccttgcttatttccagtttttggccattgtgagtaaaactgctgtgaatattcttgcgcagtttttttgttgtctttgacctttgttttcatttatcttagaaaaatacatacgagaggaattgataagtcatgaggtagatgaaagttcagttttcttggaactcctctggtcgtaccatttcacattttacactttcaccatgagaattctggttaccttgcatttttgtcatgtgacattaggtggtgatggttgtttttagccattctaatgtgtgtggaaagatctatgtggttttaatttgcatttccctggcaacactgaacactttctaatgtgcttactagccatttttatatcttctttgtgaaatatttgttcatattatttggccattttctaattgaattatttgcccttttattattgagttttgggggttttaatatattctgcagatataaaaatgtactttgtcaaatatatgatttatgaatattttttcccagtttgtggtttacctctatttttttagagacaaaaaaaatgtcatattgctgtcttaataatatttatcaagtcttttagtccatgaacttattatgtcagcatttatttaggtcatcttttatttctctaagctgtgtcttttagctttcagtgtacaggttttacatgtgttttattaaaggtgttatatgtttttcaacactattgtaaatggagtttttaaaatttgctgctacttgtttgttgctaatatataaaaatacgagttttgtataataaccttatatgctgcagacttgttaaattaacttactagttctactaggtatttgtacgttccttaagttctcctatataagtagttatgtcatcagtaactatattaaactttacttcctccattttaatcttcatgcttcttttttttcttttctttattctttttttttttttttgcctattgcaatggccgggaccttcagtacagtgttgaacaggaatggtgagagtagatatccttgtcttgttctcaactttgggccatggttcagatttttttaatataaaaaaaattgtggttccataataattgtatttttagtgtttgatgagaaggtgcatatgtgcacagggattcatagacttcttgcaataattctgaggagtacgtggagactaaattatcattttgttctgtgcaaatcactatctttttttggggggagggggagaatcaatcggaggggatgtggacagggtctcactttgtcacccaggcaggagtgcagtagtgtgatcttggctcactgcagcctcaacctcctgagctcaagcaatcctcccacctcagccccaagtagctgggactacaggcatgtgctgtgccaccatgcccggctaatttttgtatttttagtagaaacggggcttcaccatgttgtccaggctggtcttgaactccttcgctcaggcagtcctactcggcctcccaaagtgctgggattataggcgtgagccactgcacccggccagtatcttttataatgtatgtttttgtttgtttccataatctagttataatatggtttagaagtttttcaatttttgttaatttgctttctattgtaaacacattttttttgtttctgcatacccctctcattaaaagctagataatgtttcatcaactgattgaactgtaacttattttagttatagtagtgctaatagtggttcgttatgatggattcctagaagtagaattactctaccaaagggcttaaaagtctttgtggctcttgaaatacatcaccaagtaacacactgatttataatgtcatcagcaatgttcaaacctgaaaaatcttgaatttctcctgtaaacaggacttttttttgccagctttgatgtggtccagtttctgcatgtgaaatataaatgccctgctagtgacttcacctttctgtctgtttcctttgggactaagcttgtctctcaggaggagggtatttgtgaagtatttagtgggaaatttcttctgttgcagtccaactcctgaccttcaaaacctagagatgatcgcttctcggccttttggctaagatcaagtgtaaaacctagagatgaaattagcaatttatcttaccatccccattatccagtttggaactgtgatagtaatttctgtctatcaagtacgcttagtttaaacatcactcagcataggtagttcatactctatatattctcacacaagtgtcttcccagggaagaaaaaagcccatttaagatgtgattaggtcatcattggtttgatttcagttctattaaaagaatttttgttgcagtacatttcatgttttaattatgtcagaaaactattggaaataaatggctttaatgtcacccttccataatatcacccacataaatacatcaaaatgtaacatgattatgtctttcttttcatgtttatgatagtctgtctcatatttgtttttaggaaaattgagattatgatattttatagcctgagttatttagtggtttaaagaaagtcaacttttttgtttatatttattatttatataattttttaaaggccttatttatgtatgagttctttgaatattaaagccctttgttatatggactggcatttttttctacttgtttaccttttatatctgcttataatgttatgtttttgaagtatgaatgtctagttgttatgaactaaaactttttctggtttttatgcaagttgtgtcttgagatccctcatctctaagatgagttcagtgttccccatattctttgtgttctttactttaataattactctgaattttgttggtgatgactttattcatcacttagaatgtacagaacactgtgataggggctgaagtatataaaaatgaatagaggtgattatgctctcaaggagcctaataactccttggggaggataaaacttacattcacaggtatcacagtagtgctgaacaattagaaagtaccctttgtgaagcacaaaggttgttcccaggaaaaagaactcatttccaaataggggaatcttgtaaagttttatgcagaaggttacatttagggtaggtttttaaaaatgtcattctgtagaaagaggcatttagaaaattggagacagaaaaatatagctcaggctagctttggaatagttaatggtccagtacaaacaaccttcattgactacttcctcattaccaagcatgttagaagcatcatcatgtttaaacctcacacagcaaccctgtgaggttggtactattattattcccacttcttcaggtatacagagtctctgataggtaagtaaattgcctaagctgacttagctagtagaaccaagatttgaactagatctatctcactttaaagcttgagcttttaactaggctacaatgaaaaagctagcttgcagccagattttaatgaaatcataatggtctttccaattaaaggtattgtaccctaaagactctatgtattattctgcacagaaaagtaacagggcttgtgttacatgtgcttcttaagaagaaaaaaaaaaaagtatctggaatatgctgtctttgagtgttactctatcatcacgtggctgaaatttgacactgccttttctttcaaggaaacattaccctgtccaataaatgaaactgtgccgatttattttattaaggggtatgtaggaaatggattcttctctagagtatgtagaattttatgctgttctgctgcagatatgctatttcctgaagaatattccactaaaaataattcccttccatcatgttttttatatgaggcatgtgtttgctgtcttattttaggagaggagtatggtacagagcaggagtagcgtgttcatcctagagccagagcagggttttcagcaagaggatggaggtagaatgtcaattaaatatggcaagagaacccatgttatagaatatataaggggaacatgggatttagagtattgctctacactgttgccacaaatagattttccctcaatagttctttgaagccattctattctaaattccttttacttgtttcagtgtcttctgacattcacctggtgacagttcttacctcactgaaaaaactcaaaactaccttacaatcctgtcttcagattgtctctgtatttttactccttctgccccatccttccctacactgctcctccatgtcttgattctctttccttccccaccctgacttctgccaggttgctgctgaggactcctgaccttgcccattgtattgatctctgtgtcttaattgcctcacctctaaatgtgaggggtgggggagtggcagccgaatgaataaggttttttataatagctttataaagctttataactaactgtctcttgtatctttaatgtcttcacttcttctcatcatttttggccaaagatgtattattgctggggtctccctattcctcacttccgaaaagctagaagctgtggccaccttttatcttactttcccttagaccttctaacccatcactccttcttttcattgcttaccctctcagaactatctgcctctaattctttcttcctgctttctcccagtcctttacaattggcttctatccttacccctcttctgaaattattctctcaactaatgaccagtcgtctcttttacccattctgccacatttgacactatcaacttaccaaccttctaccatgacttttatgttgtctctggtttctctttctcctctggccctgtagatgtatatattcttcaagcttttgaccttcatcattttttctacttgttctacttgcttccttggatgattctacccatacacatgaccatctgtatctcttacctgactatataattcaaatcctatgtcttaacatccctagttcaggcctttctaagctctagcccaacctttccatttgtctgtgagagattttctcatgaatatcttagcaatggaaactctatgtttctaaaattgaaacttgtaccacccccctttgtccctccttttacaactccatcttcttttatcatcagtcctcactagccccacacaaaaacaagacaaacaaaaaaggctcagtaatgaatagttaatggcatgaatctctttccattaacttaggctagaactgacagaatctttcatttaaaaaagtcttttgagtgattgccatattccaagtactgttatgcaatcttggaatacattcaaagatccctgctctcaaagagacacagtatacaaccagcataataaataaattatacagtgtgataaaatgttgtgggaaacagggaaagagcagagtaatggaatagggattgccaggattgtgggtaagggtttgaaaatttaagtagggtagtcatcgcaggcctcattgacttggtgacatttaagaaaagtcttgacggaggaaagagttagctgtgcagatatctagagaaagagttccaggaagaggagccagacagtgtgaaggttcgaatgtgggagcaggcatgacatgttcaaggaataacaaggcagccagtgtggccagagcagagtgagcaagggagagaaaaataggagattgagtcaaaagggcattgggaggctactataggggtttgactgtagttctgaaagagtgatatgatctgatttacatgttaaaaggatccccttgtctgctgttttaagtccactgtaaggggcagtggtagaagcagggagaccagttaaactaattgctgtaatccaagagaaagatgatgactgagatccagatgatacagcagaagacatggtgagaagtgttcagattctggatatactttaaaagtagactcaataggatttactgaaagattggatgaaggatatgaaaattagtaactggttacaaatggcaaaaataatatgaatactagagacactgtggaggatgaagtggaaactcactgtattggaggggagtggaaaagggaaaagttaaagaactaaacagtgattactcccatagtgatctcatctggtcccatggctctaaggactgtcataagcacattacttccaaatttatattcttagtccaaaacactcttccaaactgtatctgcctacttaagatctcaaacctaatatgcctaaatctgaacccgtctctccccaaaatcttcaactataatctttttcatctcatattatttcagttcatcctttcagcttctcagttcagagccttgaaatcatctttgatctgacgagatatccttagctggaaatgagatctttctccttgaacaacctttatgcttcactaagggcatttactaatttcttacctctgttatggtatctgtgagtataagttatatccttcctactttgggaggctcctggagggcgtaaatcacctctattcatttttacattcttcagcccctgccacagtgctctgcacgttctaaatgatgcataaaatcatcaacaaaattcagagtaaatattaaaataagagtacaaagaatatggggaacactgaactgatcttagagatcaggaatcttaagacacatctgggataaaagcaagaaaaataatgttaattttttttcattaaaaagctgcttttgatgtaccccttggttactccaccataccccacttactcataataggctcagatggtcaaaaaggagtagaacatagtagaatatcatagtaaagccatgagctccttcaattgtccttgtctctgcaaaataaataatgcatctgaaaatttggcaccagatttactaagctagtgacaattaaatttcaggttagtttataattattggctgtaagctccaataggacatggatcataagagcctgttttacctctctatcccttgcacctgacaaatactgatacggcaatgtttgatgaaaaaataaatgataggaattaataatgaaagatgactacataaaagaacactgaggaagggaactactcaggaactgataacttcagtagaacaaaatgaaatgtttagctttactttaattcatgtattttttttttgtataatctaaactggctgtggtcaatgcagttgtataaacaaaattgttggtagaacacatagatcatcctttcctaatgttgcctttcctaaatattgtgtaagtacttcttccagaatctcttgtggattgaaaaaatttcaagacctccccaaactgaatcccatttgccttcacagagcattgtatccagggccaaggccctcctagattttgcagactaaaagtctagagaccatgaaagaggatttcttactgttttctgtcatcatccagaaactgtcatgtctgtgtgtgtgagtgagtttgttgtgttgtgtaccataaaccataagtaaaattgctgctatattagtagaatgagacccagaaacagcctatttaggggttattctccccactactaccccctctgtttttgtcctaccatttgggttgatccagagagctaaggcaggtatccgatttcctctttttcttgaataaggtgccaggagtagtgcttggtgctgcagatgatgctgatttgtatgtgccacagtgagacctggcactctcccagagaatctgctgtattaagaatttgattcactccagatagttaagcttgaaagtggttgtgctcttgatttaacttgaaaaatatcaggaaatttattgtcaagactgtcacttggcactcattttgataaagcattagctagtatttgttatttcaatttttcccattagggaggaattctaatactagtttctataagtggttaacagcctgtgtagcaggaatatcacatgcagtagcattggaatggaccaggtaaatgtatgtcaaggaatgatttgtatcaatacctgtttgtgatatttgtactataggatttcctttgtttctgctgatgtgcttatttgtgacccttacaatcaatgttgaaaagtatcagagagtagacagccgtcaatgtaaaattcaggtctgggacaggaataatcacatagcaaaatatttatttggggagggaagaaacttctgtacaaaagccaaacagtgtttttctttaatttactaaaaacttgtgtcaggtttttagaaccaaaagtagattaacccaacagatacacaaggattccgtcatgagataaatgaatataaagattcctaactggtgccctgagctaaaaagtagttgagattgggggagggccttaaaaggttctgcctagctccctgccgtggagctaaaataagtcaagccagatagtgaagaatggcctctactgaagacccttaatgagtgggcatatctcagtctctgtctctttcccattcctgttcaaggatttagcatctctgaactgctccttgagaattgccttcagagtcttcattgccttccctccaaccggagcttactgccgagcaaagaagtcttctaactaataagtgactgtaatgcaaagagtttacattggttttatttaaaaaacaaacagcaaccattgactcttcacagatttgatattcagagttttcactatgagcaaccagaaggcccatgagttgtaatttgcaatttttcttacaggtgagtcagcctactgaatatgtctaacacacctccctacatctaaaattcaccacagcttcgttctgcattggcatgccagctaactcctgcaatgataaaaacacgttcctttgtgggaaacttgcctgaaaagaaatccaactgcaaatgctgtacaataaatgatgattaggtaaacagacctaagagattatttgcaaatttgaaaaagcccgaagttttctgaacttggacttgccttataagaattggcagcagggcagaaagactcgttcctggcttttgataaatgataatgtaagatgtgtatcaattagttatcctacattaatttctaatagacctatggctagacaatattagattgccttataaaaagacatagcatcataaaagagaggccaaacctaaaatataaaaatgttaagtggacagattgctaaaagttaattttgtttttaaagatacagcagtctctctatgttgcccaggctgtactcaaactcctgggcttaatgaccctactcctcaccctccctagtggctgggactacatgtgtgtgccactgggcccagttttgtgtgttgttgttagtagttaaaacctaagcatcttactctagttcccaagaagtaacattcatattttcaaaagtgcccttacaaatgagaaaagtgaaaaaaattcacccacttgagaattagatgatcaggctatggattgattgtcatatccaatgtcttacacactgttccaaaacacagcccacatgacgtttctggcaaagctggtagaggaaactaggaagatcaagaacctgagacttgacataactttcccctaactcagtctggaggcagtgaaatgtcagactgcctggattcaaatcatggctgtttgaactgggaatgttatttaacctctctatacctcagttttcttgtctgttaaatgtgcgtaataatagtaccatatctcatggggttatattaattaatatatgtagaatacttagcacctggacagagtaagctagtgttaatatgattattattgctgttatttttgttgtgattgaggaggggctaagctaagccataaaagaaatgggggtagttggagggagtgggggagagttacaatggttggtccccaagaaaaaaagttgttttttcatgtgatctggatgtaatttgagacatttaacattgttaatgaatattaatattgggttttgagactggagaaaatgctggtttctctcctgtgtttctggagcaacctattagtacccaatgaaggaggagtgtgagggagttgctggccaatcataaagttgtgcttgcttcagcctcttccatcttcaaaatatttgcctgtccttctcctttttttcttttcatcaagtttagaccactcagtctggagcctgaaactcagtaggttattgatttagtttcccattatctccctcctgcccttcctgcccccagcctagctatggattttaatcttagcttgtcttctgattctcagtgtcaccataagcgagttactttgacctcagttgcatactctttaaatggaataacgtttttgcccattcagaggacaactagggatttattgaaatggcagatgttaagcattttcaaattttttgataggaggattccttgacaggatggcatttatagtaaaaaggctgtttcccaaggaagagtcctctacctctgatacataggttttattccctagtggtacaaggtctgtttaatttcagcttttccaccatgagcctgtatgtttttaaatactacttttttaatttgccctcttctttcaaacattcacaggcactaatccacattatggctttacaggcagtaaattaaattatattaattctaaacacagtgtttttgagctgtagagagtctgtagcctttgaaaccactaacttaattttgtccaactcttattcagaaattcaaaaagagccaaagctttttccttttgaatttggtttaaaaaatagtaagaaatttctcccaggcagtggtcctgggtgccaaggtttatcagagatctaaatctgtctgcatgaaaatctccgaaagtaaaagggtaggcctgctaatgaagatgtaatctgttataacttttaccttcactactactaccttatgttgtcaggtgtgggcaagtctcttaatctctctgagattttgttttcttatcagcaaatctacattcacaataaatatttgagataattaaatgaaataatctgtactgcgcactttcaaaagtatctgtttatctgcacataaagtcctgcctctaaaagagcagatacaagcggaagactattttatactgtcattacttaaaattagattgtaagctcattcaaggcaaaggctctattatctttcatagagccttcctccacagtaaataaatgtttattgaataaagctgagtatgcttttctaaattattctttgttggtttcagcattttgtcacattcctttgaagagccttgattttagcaaatctttatcatttgggcaggggaatggcagggtgtgtgaaacaaccatactcacaggaaaagggtgatcaggctgcataatactgggttgttgatttttttttttctggttctcttttgggagggtaatggtttgttatttttcaaaatgtgagaagactgatattttaatgtcacttgtaaatttatttctaagacagttcctacaacagtttagatgtctttggagcaataatagcaacatttcagtacacaacacctttcctatttttatatactcatactcatttagaggtatacgtacagttgtttaaattatatgataattacacagtataaagcgagtggttctgaaatagggaaagttgcataatcactgtggttgtgtatggcattggttattatttcactgatcttagatactttgaggtaactatatgagcactgttcaactatttctgaaaagatgatcatcctaaatcttttagaagatttctatctcgggactttttaaatggcactttaaaaaatttttactcttattcagtaatgctaaattgctaagtaatagaaattttaaaataaaacagctttctaaggatatattctcctacatacaatgaatgcaacatgcaatgagtatccagtttctgtacatgtataacagatctttgaaaaagcaggaaacatttagtaagttcttcagaagtcagaagcaggtaacagtctgatgcttataataccaagtcctttggaagacaaactgcattccttcatctatgacaggaaatctttctcttgtcatttcttttttttttcttctactcatatatgcaggaggtgctccaaatggtaccaagaaataacatttaaaacgcccccacccatgcccagatagctgcatgcattttaaaactatattctctcatcagagtctggaagagctttcagaacaacttcatgactttctgaaggggttacatttttaaaatgtttatcttagtatgttaatttactgtaaaaaaacggtctcagctgtaagttctactggataattctttgccctttctgtggttgattattatgctaagaaatgccatttaaatattattttcactagatatctgttagcttctgtagtacaacaggtagttctgtgggcctctctataaatgaatgatacttgaatttataattacttgtatattttgcaccagcatagattgttaaggattctggcctatttcagtatcttggtttaacaaggaggtaagacatttgaaaatgccaggtgcagtggctcacacctgttatcccagcactttgggaggccaaggtgggtggatctcttgagcccagaagtttgaaaccagcctgggcaacatattgagacctcacctctacaaaacatttttaaaaaataaaaattagctgggcttgtggttccagctacttgggaggccaagggaggaggatcgcttcagcctggaagtccaaggctacagtgagctgtgattgcaccactgctacagcccctgggtgaaacagcaagaccctgtcttaaaaaaagtttgaaaagattcctcagtgatgattaaaatgcagttcacattgctgtccctttgatttgactgctagaacagcccctatggtgaagccagcactccttctgtaagctaatctaaataggtactgtgatattctcagctgtgtaaattcagctcctctgtagatagcataaaggagcagcaggttttcctcgtttgccacacttgaatttatattcaatttttaatattaagagcagtaaatttgaaaatagtaataaattttaaagaaatgtatacatagagtaacatatatatgttatatagagagaaaatatagaaacagtaacagatttttagagtaacaaattactactgaacttgcatttatgtcccacagtttacatagttttttagaaggccagattttcttagagtataagctttctttttaaattattgaatatttaacctgtattacagattaagacctgctctgtctacctgtacctattcatttctaaaatgatgtgttcttgcatttaattttgtgcttgttgcgttactccattaaaactgagtaaagctaatgggtaaaaatagacaagtaggaaagtctcttgaaagtgttgagagtgggtagactattagatgtactttgcccttatagcatggttcttggtggagttgtaaatcatatgttttgcccacaaagcacgtactaatattaagttgtttttaaagtgattgtgttgcatcaccatggttcttctatgctctgtggggtatcatgttgctttaatgtaatgaaccaagtcctcagctcctaaatctccatgctggaaatgatgacataaaactgaatggccatgtctgaagtcatgaatcttgagaatttcttattctttgggaaaagccttacaagacttttcttattctttgaagggaaaagccctgcacttataacaagtttctgttgaaaatattagccattttaggttatatagcattctgtttgaaaaataagcattaactctgctgcaaggtctgtattttaactttgtgcagatgtgtgcttaaagaacatgatgtgcttatttgttgcatttatggtactttcttactttaagtaagatggatgaaattacacattaaataaaaacagcagtccttaccaacctgaaaaagccttccaaaaacagtggagaaaatgagaatatgactttaataattcattgacttttgaaagaattgtctatttaaaagcatgtatataatttctttgcaggtttcctcagtgtttttaatgttaaaagtaatctgccagtaaattatttgtaaaatattactaaaagtattattttctttcctaaccaaatatagcactttaaattttacatatcttgttatacacagacatatatattgtgtgtggcataaaactccagttagaataacatcatggccttggacaagttatttaaactccctgaacctcattttttttttctgtatgatatgatacctaccttttaggatcattgtcatgattaaacgagaaaaatctatttagaacaatgtctgacagatatttatcactacctgttcacttctgtatgccaagcttcataaagcagtgtgtttttatttggtacttttgagccagaaagtactttgtattgagtattacttaccacactcaattctaaagtgaaactttgtattggatattacttatcacacttaattctgaagtgaaatttagaatatgtagaataaatttttcttaggatatttaaggaacatatgtttattgaatggctactaagcataaaacattgtttcctatcatgtacagttgactatatttaaaattcattaaggtagaggtcagtctaaatgctattcccagttcgttttacagttcctctgtctgttgttggctctttgtgtgtgtgtgcgtgaccttgttaactttaagaaagttttcaaaataaaaaagcacttgactttgtagtaatttaaaaataggttgatcaatatgaagcattagctaggagcacaagttggtgcttttttattgatttcagttactaatgccctcaggcttatatgtgtgagaatgaaaatgatatatgaaatacgcacccaggttaaacagacaaatgttcttgttacatctgcaaccactataggcagaattctttatttggaagtgactttggtagtagttagttcctctctccctctctctctgtctcacacacacacatacacatgtgcaagcaaccttaagatagactcatacagtgctttgggaagtttctgccatttagttacttttattaattataaaatgctattcaagattctagacttacagcgcattagtatacattctgtcatttttaacagatggttagaagccagaatcttgaggatttgaaagatactccgctaagtagccagttgcagaccaataaaaccaagaaggtgaataccagggaagcctgctcagcagggcacgcattatttagaaagttgtataaggaagttggatttcggcagaggttgtcatgtgtcatccgccccatcagtcagagctccagcagctgttccttgtcaccgggacccttgtatgctactgttcgtccatcagcactaagagataccggctgcctttccaccatgctgtggaagccacagacatacagacttacagtgttatctcactggacaccagtttggatgaaagctcattttcaaagagggagaccaaacaccaacgttttggtattttattagactattaaccaaaatacattctcaagagaattagtcggataccataaagtgtgtctatttttggccatatatatggctgtaataatgtaggagtgttgcacatttgaattcaaagagatgccctacttaagtgagagatgggagaactttctccactagatgccagattattattatcagagtatcactgtgaagagacctttctggttgaacacaacaatgcaaaaaagacttaaaatcacaagcattctttttttgatagtgcagcaacctgccaaataggatatatccccattctgattatagacaaacctccaacaattccctttttctctttttgtattccagaggtatccctagaggaaaggatttgagggcattagtatcactatctgcctgattactgtgttgacatttttaaagtgccattaatcataggaaatggaacttaatggtgtagaaaaatacccagccaaggaatgtcaagaaagtaagctacagcccagtattcacatgaaattaaagggaaatgcatcttaacccttcaattctttttttcttcttactgaattataaaggaaagtaattgagaggtagctttgcaatcaaaggtaatggtaaacatagtaaaagaaaattataaaaggcagatgtttttattttacaaatattacagttacataatgtataaagaatataaagataatattcatctttagatagtataatggaagttttacctgcttccattttggaagaaagttactttttctttttgatatcccctcctatattttttctgttgactctgaatactgaatagacttgatataatttagtttatatgaggctcaactgttacggaatttgagagttattaagctgatggtatgctgcacaggtaatactgccatcaagggtatacagaagtaaaaagcagtgataggacacatgaatagagtaattcatttttcaaaagctggcaatatgtaatgcacattttgttagagtttggtatcatttcatcgtttgcctattagctaatttaaataaaatgttttcctaattgaaattgtagggaacagatagcctcatttttaaaatatatgtgacactaaacttataatgaatattatagtgtaaaatatttttggctggacgcagtggcttacgcctgtaatcccagcactttgggaggccaaggcaggcagatcacgaggtcaggagatcgagaccatcctggctaacacagtgaaaccccgtctctactaaaaatacaaaaaattagctgggcgtggtggcgggtgcctgtagtcccagctactcgggaggctgaggcaggagaatggcgtgaacccaggaggcggagcttgtggtgagctgagatcttgtcactgcactccagcctaggtgacagtgcaagactgtctcaacaacaacaaaaaaatgtttttggtgctgactctgagcaggtgcttcatttgataaatagcacaaaaatctttaatccactttctccctctccctcagccttttctttttcaggacagtttacagcacaggacacataatagattctcaataaagactgattgattgacctatgggtctaagatgaatgaattttagggtgatctgtataaggagattgcaaaaggagtaatattgttaagtgttgcgctttttattttttccactgcaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacaggtaaacagttgaacttgaattatagcaccttgcatttgcatagctcccattatctcctttgatcctcacagcaatcctatgccataagcagaatggatattattctcccattttatacatgagaaaaataaagcatggtgatcttccttcaaagtcattataattaatatccagagccaaagctagaagccaggtggtctccctggaccccttgttcactgtgtatttcccatttactaaacgaaatgcatcatgcatgtactgctgtatgcatggagacacacatttttttatggtccttttgtaagttgtctttatctcttgggagccagaagtgcaaggtaaagcagtcccttcacaagctaaaaggtgaatcttcttcctaaattatagctttccaagttcttggattctgtgtcaatgaacccattgaacaaataagataatatctctgttgattttccttctaattaaaagtgctctcagctttcagcacaggtagatggtgagggaattatacttccatgtaacaaccatagttgttgagagcagtgacccagtgaaaaagaattacagtatcaaatgacctacttcccaaggaagtttgaataggaacccctgagatttaaatgaatccgctcactggtcttataaccagttttgatgattccgtgtttagggcttggctctttttattctggtttaggctgcattgagatggttagacatacttctttgaaaaggtttaaaggagttttgaaatacatccagcaagttcattgtactattccttcttctgtagggttgttttgtttttttttaagttaaagaaaaataaaatgacacccagtaagaactatgccaaaaatgtgggagtagaagcctcctagtagtcctccacacaatgtggatgtttcagcagacaaatccatctccatttggaggcccagtatccttttatgggaatttctgggctggtttttagcaggagtactaggtggagcagtggttctcaaaaatactggatttggaggtggtatggctgcaccctttgcattagagggttggcaaaaaatgctgtaactgcaggtatcctgtactggatttttcacatccatcttcatttttctgtcatagtgtcgattgttccattatcccagttgcattgtagactcagagcaaagatcaacactcaaattatatggtccaattaaactaccaagttgttgagcaaaaagacagatgcatctgggctctggactgagctttccacttactgcagtgttctatcagtgtggcaagtgaagttttaaataggtctctttaaaaaaactttggaactgacctttgctctaatgtaagtcacaattttcaaaatgtctgagaactttcatcttactactaaacacatacccaaggtgaggaaggcttacaaactatactttcgagggggcagatagtattttgggcatttccacgtgatgatattttatgttacatctcttttctccattttctcaaaagtatttcctttcttaatgcctcattctttactcataataattctgtcttttgttttgtcaatggtgtaattaatttcatgtgtattaacactatggtgactagttaatttccctaactgggtttattagaagcagtccagacacaggggctgaaaatgcttggctatgaaagtgttaaagtttgcatggtacacagaggattttctgatttctcagtgtccccaactgtcttcaggaatatgttaagtagttcctgactctgattttccttgcaagattaaactaaacagctgatcaggaacccttagggaatctgcagcagctggacctccccaagaaaagagagagagagaaagaatttccaagcataaaaacaatgcctatggggtctcggagacccgtcctacctctgcccctgatcagtgacttagttccactttgctttgacacagccttagcctggtgtaatattacattacagtaggtttcttgcttttggaattcactgctttagcatcaggtaaaattccacagaatcaattccaattttagcgtactcatttttatgtgtacagtgagatttggagtttaaagaaggtttttattttgttttataagaaaaagcttaatttttaaaacgtcttggtatcagtatggttggactgggggaagggaagaaaggggtgaccagttgttaatacaaatgtaaaggatagctttaacaagtcatcaggataaagccaacagctgtggaggaaaaggaaatggaatgggtggaggggaaaatgaggccttagtaaaaggagatccaagcatagaatgtgttctttgttattagagtcaacactcagtaatcctaggaaagggggccttcaggaggagcatggataaatggagtccacagataatccacagccccgtttaaactgttagttctaactctaactgtctccctcataaaaacctttgtttttaactagaaccataatgattccttggcatgctttatgcctaccttttggacaataatgaacaaagaaatgtatgctggggtgagcaagaaaaaagggctataaagaacttggaaacagaaatctgtatcttcatcattgtttctctagcacccagcagagtgcctggccaggagataatagagttaacaaatgtttgatgaatttaattgaaagaagagaaagaatattagatactacctggtctgggattctgagccatagataatcaagaatccataaatgttgattggataaatatatatgaaataggtgggaattgattttctgagttccaaatttgtgggaagaagtgaggaagaaagaacatttgaatttcatccacatttggccaaaagttgatgtactttctaccatctttaaacaatttaataatccaggcactgggggaaaaaccaaaaaaaaagcttccagtctcttgtttccaaaggtcttactttctcagtgtttgtggtttagctttgtatatttgttaagcaaatatatattctcatcacctcttcacaaagaggaaaataagactgtcttctcgatccttatgtataatgctagtgtgtagcattgtagaaggaagtaaattttcttgaattgtttctactgcatgaatgctgtctccaactgatatgcatgttctctgaaggcaagcgttggtctgcagctccttttataatccccccttaatctttaatattggtctgggcacatagtatgtagtaagtacttattcacaaagttatgttgtatctaggaagtacaatgccttatttacacttactttttttctcttacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtg

SEQ ID NO: 38484 - DNA, 11173 bp, Homo sapiens
cttgactttgagcgtccggcggtcgcagagccaggaggcggaggcgcgcgggccagcctgggccccagcccacaccttcaccaggtagggacgctcccctgctcagagggcggaaggtgtagacagagaagaaacagggggagggggcaggtagaggaaccaagacagatggcagagagagggacagtggagggggacagagggacacaggaacagaagagaggtgtacccaaaagaccgggggagacaggaaagcacaaagtcaaggacccaggtcagggatggaggctgctggagggcagagagacctaggacaggagagaagaccttgggtccacaggatgagtgttgggtgggagcaccaagaatgccaccaccctcatttccttgtccttgaaggtccctgcctaggtcagggaggggctccgtttctgcccagtccccatccccctatagccagggcccacacactggggctcctctgcccgtgtcctgcctggggactcaggaatcgggatctccctccctgctgggccctcttgaactcacagctccaggaaactgggagactcatccctggtgttccagggagtctctgctgcccaccatctctgccccccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggtgggcactaagatggccaggagggtgggtcactttgtccacctcagactcagcaaggctcaagagcaaagctgatggatgcactgacatttccaggggaagctctgtagaatctgggactcttccctgcccctctgggaactttactctccagcaagactgaagaagctccttggttagaattctaatttggcccagggaaagggcaacctcccacattttctcccaatcctgtctcttttccagacacggaaggtgctggccgcacctgctgactcactcttgggctgataaggcacatatgggttggtgagggtcatcttagccatttttctgcctttgctgaggattctaggatcctgtgccccgagatggctgctcatacctgggagatgggtcaaatcttttcctgctttcagcctcaccatcatccttttccatgcacttgcccctgtccaataggagaatcacttgcgttccttcccacagttccatggggcttgggccggcagactgcatacctgagctgtcatctcaagagtgctgtgttatcttaggacggttgcttaccttctctgggccttggcttccccatgctcctcccactccccatctccaagccctaacttatttaaatggaaaaggatcccaggaatgttgtggctggcatccaagtaaagtaagaggaatccaggttggaatcattgaagaacttcccaaacagcagttggtgtgtgaccctgcaggatttgtcttcagttatagtttaatttcagtgagagctggtgtgtgtgtgtgtgtgtgtgtgtgtgtgtgtgatgtcttcagttatagcttaatttcagtgagagctggtgtgtgtgtgtgtgtgtgtgatatcttcagttatagtttggcttcaatttcagtgagagctggtatgtgtgtgtgtgtgtgtgtgatgccttcagttatagtttaattttagtgacagctggtgtgtgtgtgtgtgtgtgtgtgtgatgtcttcagttatagtttaatttcagtgagagctggtatgtgtgtgtgtgtgtgtgatgtcttcagttatagcttaatttcagtgagagctggtgtgtgtgtgtgtgtgtgttgtcttcagtatagcttaatttcagtgagagctggtgtgtgtgtgtgtgatgtcttcagttatagtttaatttcagtgagagctggtgtgtgtgtgtgtgtgtgtgtgtgtgatgtcttcagttatagcttaatctcagtgagagctggtgtgtgtgtgtgtgtgtgatgtcttcagttatagtttaatttcagtgagagctggtgtgtgtgtgtgtgatgtcttcagttatagtttaatttcagtgagagctggtgtgtgtgtgtgtgatgtcttcagttatagcttaatctcagtgagagctggtgtgtgtgtgtgtgtgtgtgatatcttcagttatagtttggcttcaatttcagtgagagctggtatgtgtgtgtgtgtgtgtgtgatgccttcagttatagtttaattttagtgacagctggtgtgtgtgtgtgtgtgtgtgtgtgatgtcttcagttatagtttaatttcagtgagagctggtatgtgtgtgtgtgtgtgagacagagagagagaaagagagagaatcttggaaaggttcaaggtacctgacctccaaggacctggccaattagcccatcctctctggttctggttccacttctcttctcttcccttccaacaggatgtatgcatggaggtcgtatctatccagtcttgggaacgtactgggacaactgtaaccgttggtgagtgtttggagcttagaggggtcttgctttgtgagcctgtggctgacagacttggttcaaatcttatccctgaccccttttgcaagggagaagtcttttcccttctttgaacctcagtttcctcatctgcaatagaggaattttaacactgaccaagtcaacttatctaacatcattccaacaacattcctcaagcatggccagccatgggtgcctggcccaggggtcacccttgaactgagatccttccccacccctcctggcttgggctgggctattcctcccagctattcctgctgtcactgcagagtcagagggagaagggggcgccaggaaggaaagctctgactgcagcatccgctgccctgagcggatgagggtcagggatggctgagcgggcggccagccagcctctagcagggccttccctgaaatgtggcccctttttccttccccacccctccccaccattcccagtaggaggaggaaggggtcatgggtacccccctattcagtctgagatgggaagtggagaagggccaggtaggaaaccctgaaagccttaatagaaataatggggagcctgcgacttggaggaggcggccctgcacccactccacccccactccctctttgcctgggactaagaggccccagagagaaggaaactttttggaatgcattgcgcataagatatttccattgcctcactagggtgaggggtgcccgggtcacagtgagggagggaacgtttcagcatgtgtctgggtgttcagcgtgactgtgtgtgcactgtgtgtgtgtgtgtgtgtgtgttcaaaaggataaaacatgcctggcccgcgtctgcaggttctgataggatggctctggacgttgaggggttaatgcgctctctctctctctctctctctctctctctctctctctctctctctctctgtctctctctctctgtctctctctgtctctctctctctgtctctctctctctcactgctgtccctggccccttaggccccctctggaatgctgggacctgctaccaccggccctgcctggacctgtgtgggcagccctgggggcaaaggaggagatggcaggaaaggacagaacagtctactgccctctcctcatgaaggctctgggggcgagggtgggggagtgtccagggtgtcagagccctcaaaggatgcttccagagtctagtcgggtgctgctgcctaggtgtgcagagggggaacagcctggtgtgcagagagggaaaggaaggatgaggaaagccttcccggccctgcagactcctctggccctccccagcagtgcccccgcctctcctggggctggaaagcccagccatactgggtcttggctccccttgaggctccttaaaaggcaacattggaggtgggagccttggacagcttgcaaggaggcagttcagcatcttgtaataacagagttatgagcttgtaaaagcattatagaattcatagaatgcagcccttcagtcggcacctattattaaagacctactgcgtgacaggcactatgctgagctcaggagatggagcgggaatgcaacagacacagtccttgtcccatttctagtgtaaggtgaagggcatgggaagacaacaaatgagtatattctgacaagctgcccagtgttatagggaaaagagaggataacgggggtcccagtttagagtagggagtgggtgggaaagctactctgaggaagggacatttatgctgagaccagggagaaggataggagaggcctggcctaggcagagggagtggctcgtgggaaggccgggaggtgactgagctcattttagctggagctggggtaggggagagacgtcccaaggaggtgcaggccacgttccgtggctcacatcagctgtgcccaggattctgcattttgtttggagtcacaggaagccacgtagagagcacacggtctgatttacgttcttcaaagatctctctggctttggggtgggtagggaggggatggccgggaattttaaggggtagcagacttggtgaataaggcagtgccggggtccaggtgagaggtgatgagggacgggagtagggtggccacagtggaggggcgagaggtaggtggattcctcatgtgccatctccaagccctgctgatgggggacatgtgggcggacaccacagaccacctggagctctgatgtgaacaactgggtgccattttcagagttgaagatgttaggaaagagcaggcttgtgggaggcagacgggctattttgagtttgagatgccttttgcacatccagagatgtcagaaggtcagtgggatatgagtctgaagctctagagaagtggggtctgggattcctgtaacagaatggtgatagtagatattaattctgagcacttaatgatggaccaggcccagtgctaaatgctttacaagcctatcattaaatccctggaaagtggtaccactgtattatcctcattttatagacaagggcattgagagagacagagcttgaatgattctcctaagatcacacagccagtgggctgaaacccagaatctgaattccagaacccatgctcttagtcaattcagcatatggcctcagtcattgactcagttaacaaatattcattgggtgcttactatgtgctaggctttgttttcctaggcgctgaaaataccaaacaatacctgccctcaaggaatttacagcctatgaggaaacagggataagcaatataaacaggccgggcctgtggctcacacctgtaaatctcagcactttggaaggccaaggcgggtggatcacttgaggccaggaatttgagaccagcctgggcaacatagcaaaaccccatctctacaaaaattgcaaaatttagctgggtgtggtggtgcacttgtagtctcagctatttaggaggctgaggtgggagggccacttgagcctgggaagcagagactgcagtgagccgagatcacaccactgcattccagcctgggcaacagagcaagaccctgtctcaaaaaaaaaagcggggaggaaggggagcaggcagattggtgtgaaccatcaggggccagcctagttggagccttagaaccagaacttgaaggaggaggggatcaggggacaggaggacagagcgtgcagggccttgttgtcaccaaactttggctcttattctgtgatgtgaagccagtggagggttttgggcagaggaacgacatgatatgacttaggtttagcagggtcactctggcagctgtgttaaaaataccctgggaagcagggcaaggggcagatgcatggagcacccacagtgaggaggccacagcaggaatccaggtgagaggtgatcggacttgggcgggctgcaggagagaatgagagtggttcggattctggatgcatttttaaggtagacccataggatatgcggatgaactggatcagcatgggaaaggaagtcagcggggactgccaggtttggggcccaaactccaggaaggatagagttgccgttttctgagaactgtagggggaataagtgaggggggtcaggaattcggttcagggagtgttttggttcagggtagtgatgttgagtagccgtgagatccttgactctggtgttcaggcagagatctgggccacagatataaacttgagaatcatgaactagacgttgacatttaaagccaccaggctggatgggatcacctagagattctcccacagtcacttgcacagactccctggcccatgttaacctccgaggccacattccttcaaagtatccccagtcccccacttaccctttccttctctccttttctcaccagcacctgccaggagaacaggcagtggcagtgtgaccaagaaccatgcctggtggatccagacatgatcaaagccatcaaccagggcaactatgggtgagaggccctagaggcaccctcagtgggcacacatgcatactcatgcatgtatacacgcatgctgtgctgtggggcacgtccagcaggccactcctacacccagatttgactgtgtgtgcgctcagccactgtgcgtctctcccacccacatgcacccacgccaaggaccctgagcctcggcagatctgtgacttccttccgtcccctctccttcagctggcaggctgggaaccacagcgccttctggggcatgaccctggatgagggcattcgctaccgcctgggcaccatccgcccatcttcctcggtcatgaacatgcatgaaatttatgtaagtccatccttccccacaatgctgccatctccccatggctcagaacctcagggatgctggccctgtgccctgctcctccaagggcctggaccatcccctactacaaggctgtgtgtccctggacaagttactccccttctctgggcctctgttccctgcttccacaggatgtgctgtgctggaagaactgatgctcagattgaatttcgtggtcttggcatcagctcccccctgatctctccagcctgggaaaaatgctgttggtctcagtacagctgggttagggcccaaggggacagggggtcaccttggtattttgggaagggaaggacacacactcctccagttctggccagagggcagcagttctcggaaataaatgccggttcagcggaaccccaagggaggagagggcttctcccttcccaccagtgggaccctctgggagaggaatgaaaaccaggcccaaagtgaaagggtgaggaaggggagcttcagcaggcctggaccgggacatgtgccggagcatttgtccatcagtggcaggcagcggggaggcaggggctggcaggagtggccctccctgcggagacttcggccttgggtgaccagaccctggccctgcccttattcccctgggcctctggctattttctgcctcttgctgtttgtgttggcagactgcctggtcacgggaccctactgcctcttccctcccctgagggaaagctaaggcctgaagaaagctaaggccgatcagaaggtgcagaggaaagaggcaggggttgagaatggaaagctgagggacctggcctggccacttctctgtgcctggcctcagctgcctcatctgggaagcaggactagtcaccaccgccaccccgccccgccccaccacctgatacctgggaggcactaaatggtgcttggttcttcaacacaagtcaaaattggaggcagctggaatcctgcagcagcaggagggctcaagattaaactgcagaaggccctggacttggtggccctccagtgccaatgggcacctgaggggcaggccagggcagagcaggaggcagacagggcaacctttatcttgcagacagtgctgaacccaggggaggtgcttcccacagccttcgaggcctctgagaagtggcccaacctgattcatgagcctcttgaccaaggcaactgtgcaggctcctgggccttctccacagcaggtaagccaagggcaagggctggcgcctgggagaggagggccaagtcctgagcctcccgacagcccctctatctcaccccaccagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgagggtatgcagcaacaggggatgtgggcagagaagagggcaaggagctccgtgggcatggcctgggccatgatgcactgagtctttctgcctttgctccctcttgctgcctttgcagggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgtaagtcagcacttgggtgagggcgccgaggcaggagggttgtgaaagcctggagtctcacccctgacgtatgctctctgtccatcccctgccctccaggacaaggagatcatgaaggagctgatggagaatggccctgtccaaggtaaacccccttatccagcaccctggttccagaagcttgtgcctgcttgagagtgggcacagtagcacaagtggcctgcacagcattcagcagcatgtccagtagggccaggagtaggggtccccccctcccacaggcagcacctggagggagcacttagagctttggtatggagggaccctggtgcctgggcacatctcaatagactcaggctccagtgcctgtgccaacgggctgagtggaccctaccttgacatctgcccacagccctcatggaggtgcatgaggacttcttcctatacaagggaggcatctacagccacacgccagtgagccttgggaggccagagagataccgccggcatgggacccactcagtcaagatcacagggtgaggggcgtgtgggcagagggggtttgggacagcagggtttgtgctaggggctctggagcctgccttgggttcttacaacctctctaaaaagccaggactgctctcatcatttcaatagggagaaaactgagactcagaaagagaaaggacttgccctgggtcgaattgaaggttgggagcctctgaaggcttttttaggaactgttccttccttacattgggataaaataactccaatatgaagagagcctcaagagtttctcaacctctccccacctcagcacctgtcccagctctgcctgacccaccgagtgacctgggaggtcgctcccctggcctcagtttccctatccgatttagggaatatagatgttaggatcactgacttcaatgaactcggtgaaatgtgctttacggtgggaattggcggtctctaagatacccatattctcagagtgtcttccttctggcccttggcacctacccctccctggatccccaagtgagggagggcaggtggatgtgtggtcccatagaactggcccctaggaggtgggtctctggaggacccaggttccctcctcttctgctcaccttgcctccacttgtccccttggtgccccaccccctcccatgctgggcctgggtgcaccgacttacagatgtgagagtgagggagatgcagagaggtacagagacctgcctgagccctaagggtgtacccaaccctccaaaggcaactgggggctggatggggcaggtttccgggattggagctcctgagagcaggtagacccagctcccttccccctcctctgctctgcccacagatggggagaggagacgctgccagatggaaggacgctcaaatactgggtgaggccgctgaccctttccccgccccctcttcccctcgccccactcccattccccttctcaccacccctccttattcccagactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgat

SEQ ID NO: 38485 - DNA, 1482 bp, Homo sapiens
ggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattgtatcctttccgagctgggggctgcttgcggcggagcgagggctggactcggggagaaggaaaggagggcgggcggggggccgacggaaagggtagcagggggggaccggggctggcgtatacggtcagaggtggtcggaggaggggaagacattgaaatggagggagaagctctgctaacggtggcctgggcgaggtaaggagtgaagggggtgacactaggcagggtgacctgagagggggcttcagaggagcaagaaggcctgagacataggcaagatcgtatcagatggcaccttaaccgaatgacccccagcaccctcagcgtgcctttcccgacccccttggaggcggaaatcgcccatgggtccctggcaccagatgccgagccccaccaaagggtggttgggaaggatctcacagtgagtggcaggatcctggtcgtgtaagttctgaaagggacggggttgggggaggcggcccatggagacatgggggacatccaaggatgagccctaaggagcgccaggtgcgctgggccggtctctgcctgaggggctgtgtaatggcagggctcccaagggtttgctatattgggtgcctgaggggcagagcgagggaccaggagttgccacctccaatttgattttcttttcccctcacttttagccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctact

SEQ ID NO: 38486 - DNA, 4684 bp, Homo sapiens
atgcaacctccaccctggtgacccctcctcctgtggcctacggcttgtcaggctaatgggctcaaaactgaccaggtcttccccacaaacctggtcctcatgttgacaggtggctgcttcatcctcacagttgcccagaccagagcctcagagccgtcctggactcctgcccaatgtccacctggccctgctatcccctctccaccacacctgacatccagtcagtggtcagactccacagctgggccctgcccacatggcccaagtccaccctggcctggcaagctgcaatggcacccaggagatgatgccctacaccccagggagccttcctgggagtcggccagtcaccttctgtgtgcctggctgtggcctgctgctctgccctcgccatgcacctgctccatgatgaaagctcatgcagtgcctcatgagggagatggcagccagtacttgctaagtagatagatgagccagacgtgtggctgtctgccagcctgctctaacagcctgacccatggactgggtcactaagaaacagaaatttcccacaggacagtagacctgtatttcatccagttcaacctgtggctggaattgccccaaaagtggtggcagtagagttcccacaagggagtgccccacaccatcctgagatggggctggttaggattctacagattgagcatgccagggtgattcgcccagagcatttattcgtggggcttttgtacagagtgggctgcagcagttcttgcaataggcagtgagagaaatgaagttctctctaggtatgtccgtgggggagggggttggtgaatggaatttatatgagggtttgaggaatctggctcaggctgagtccagtttctttctgtgttttgagcaacaacctagttactgtcatctgtgcctgggaacgttcatggctatggctcgggttcaagtctgcagaggaaattatacagttggcgaagtcacagagtggccaagggactctgtttctcagtcagcactgggaatgaaagtggaaaggggaagcaggggtacgtcacaacctccaaaatcagggtgcccagcacgctgaggttctggtaaggggtttcttccagactgcagacttccttcccgctgccttcacacagtagaaagctgcacaaagctcttggggtcccttttatgaaggctctgtcctcatgacctagtcacctccgaagcaccaacgccttggggtgaggatttcacatgggagttagggtgcacattcagtttaacacggcagggataggaccagtgctctgagggtgtctgggtagctgctggttcatccagaagtttactgggtaatactcagaaattccacaaatcattaaggtcattaccttgttaagctcccgatatggaatcgcgactagcagtgaccaattggcggtgttaactaggcgcatcttgtgtgttttcttttttctttttttatgagacagggtccgctcactcgttcaggttggagtgcagtggcgcgaagtcctgggttcgagatcctcccgcctcagcctcaaagcgttggggctacaggggcgcgcgcgcgcctggcccattttaacttcttatttttgagacagtctcgctctgtcgcccaggcgggagtgcagtggcgcgatctcggctcactgcaacctctgcctcccggctcaagtgattctcctgcttcagcctcctgagtagctggaattacaggtgtgcaccaccacacccggctaatttttgtatttgagtagagaccgggtttcaccatgttggacaggctagtctcgaactcccgacctcaagcgatccgcccgcctcggcctcccaacttgctgggattacaggcgagagccactccgcccggccccgttttaaccatttttaaacttccagttcagaggcgttcccgcgcccggcagggtaggcgcagtgcgcaggcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggtgggtgcgcgcggtgggcgggctccgggctccgggctccgggatcccgggcgggcgctggactcacagcgtctacgtccgcaggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgccctgtgagtgtccgcggacggcagcggtcggtgcctgggacggcgctgccggggcagggtggggccggggccggggactgggggtcgggctgggcgggagcggggctgcggggactcgcgcgggcgggaccctgaggacgaaggctggagtggtgaggacctgtggtgggaggaggtccgtccgtcctgacgcctgccccggccctctcgcagtggctacaagaacgtgaagaagcagcccacgggcctgagcaaggaggtaactccccggggtggggggcgcgtggagggccgtgggtgtggggccgactcgagcgctccctgtgctctcgcacctgcaggacttcgcggaggtctgcaagcgggaaggaggcgaccccgaggagaagggcgtggaccggctgctggggctggggagcgcaaggtgcgggcgggtttccaggggagggcagcactgggctcgattgctcgggtgaggcggacccctgccgtactgtcttcatcgccatgtccctgcagtggctccgtgggccgcgtggcgatgtcccgagaggacaaggaggccgccaaactggggctgtctgtgttcacggtaatcccccgccccgcctgaccgcagcaggggctaacaggggtggggcggggcgggggcactgaacggagctccccggggcgctgcggggcgtggtgtggggccggcccgcagactcctccgcagagctcgcttctcccgcagcatcaccgcgtagagagcggcgggcccgggacctcggcagcctcggccaggaggaagccgcgggcggaggatcagacggaaagcaggtgaggctgtgccacctgggctagctgtgccccggggtggggggtctcgggaggaccggagcggctcccactcgggcaggtggcagcttctcttggcgcaccggcccggcgggtggcctgccctactttacttcctgtcccagttactcctaggtttttctctaggggagtttctcgggtcacccttgaagagaggtcctaagtactggcagtggtcgggcgctgtgccgtgggagggcactcaggacctggggcggggccttttcctgccgtgggtggcacctccagggcttctcctggatggtgagcctgggcctgaccctaagagtggcctggtgggtgcaggtaggaaggtgtcaacctgccaagggcacggctggggtggggcaggggcgtgctgtggagatggggatattgcatctgtttctaacccacgtagccactggccacgtgactacgtaactgaggagtggaatttgtagtttgatttaactgatttaaagacgcacttgtgggtggtggcttcatctggatggggcctgcttgtgttcactctcttggcttgcaagactagggtctgaggcacaccttgtatcctccttgtagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggtatgccctggtccatatctgcctcttgggggtgggggcctggttgactccttccgagtgactgactgccattggtctccccaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaaggt

SEQ ID NO: 38487 - DNA, 107299 bp, Homo sapiens
gtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccaccagaggcccaggggtccctctctgtgggtcactcgtgcgtcacctctgtgtgagccgcggtgcctgatctggcctgaggcttcctgcagaactgtgcccgggacttgtcctgcggagccgagtttttcttcttggctcctgttgattgcgcagatttctgttcgtcgttgttaatttctgaggtagctccaaaagttattataattacaaggttttttccttatcacgcgtggggggcagtctgctgttatcatcattcccagttgatccagggagaaaggcaatatgagaggagttctagactcctgggagcctcagcttttcccacctgaaaaccgggagaacacgactttcccatttagcgactacctaccggtggtttagcatttaaaggtggcaccgagagccaaagcgtctgagttcctcgagttgctggtctgtgcgtttgtcaggatttgtgtttcaaatgtcttaacctcgcaggcgaataaaacctgcaaatatgaaatgtcaataaaatgatgaatagagcatttttgtctttaaaaagtatgaagcgggttcacacaaatagcattgagagctaatgtgcaacatggccctgtcacaaagtagaagtgctttcacacacatgccatttaaatatttaagccgtttagcttccagcgtgtttgtgcacggtgggaggaagatacaagtaggcggaccttttctcccttttccagcccctgttttgaagagcagttttgaagcccaactgcctaaatatgaagacagttatcttcatgttctctgtcctgtgaatgtgcttaacagtaaagtggtagtaatgatacttccttctagggggggagtagctaataaaatcccaggaggcatcgtagtgatgttggaaaagtgcaggctttggatgcagagacaggctgggctttagttgtgtgttccgggcaagccctttaatctctcagagccttcatgtcctcgttggtcagggcagggaatgcggctctttttgagcaaacttgcaaggactcagctaatttgtgttaagcacctggtatacagtggacgctcaataactgggagatgttttagtagatggctgaaggcatgggcttggtaccaggatgtctgggaccacttgattcttgattctgtcacttatcagctctgggaccctgatcaagtgcctttcggccttatattcctcttctgtgaaatgtggagaaatgatagggttgtgaggactgaatgcattatgacacccaagtgcttaaaacactgtcagcacttaatgctggccatggtcttagactcatgctgctgacatgctgagtgaaggaatttagggtaaagatcttgaaacttttttgggggtgtggagacaggacagtgtgggatggactgaaacaaagattctgtgtctgaactaggaaggctgtttaaactctagcatataccaagttcaagtaggcttcacagtctatggacttgctgtcataaaaaaacatggcttgacctcttttagtgatttcatgctgtcttcaacccagcacaatatttatttatcttgaaaatgactaaatcaggaaaaaaaatccaaggtataaagttctatgaacttgcaattttaccttttatccctaatccgttcttttttatatttagtttttgtgatatagggtttgagagcataggctttagcaccagaattctgggttcaaatcttggctctgcacttactgaggagttacttaacgtttgtgagcctctatctctgtatggggatgatgcaattacttaggattttgaaaagtgaaacaattaatatacttaaatcttagaacagaacctgggaatgtaatgagcactctattctcaatcattatggtctttaaaattgtatgtaaacttaatttgaaaaatgtaagtctatgcaaatcttatgcaaattttaatatagctgaatatgactattaacttgcattgcagttatttgtcattcacctgtaattggaaatataccagtaacaccttagattcaagttccttcacctctcacccttcaccccatctgtagacagtgggtactcagtaacccatagtggaatgactcctaaaagcagtggttttcacccttggggtggaaaaagtcacttggggtgttcattaaacattcagcttcctgagttccacttccattggtttagatccattgggtttgggatggggcgcagatgattctgatgcaggtggtccatggaacacattttagttttttttttttttttgagacggaatctcgctgtgtcgcccaggctggagtgcagtggcaggctctctgctctctgcaacctctggctcctgggttcaagtgattctcatgcctcagcctcccaagcagatgggattacaggtgcactccaccatgcctggctaatttttgtatttttaatagagacaaaaatacatcacgttggccaggctggtctcaaactcctgagctcaagtgatccacctgccctggcctcccaaagtgctgggattacaggcataagccactgtgcctagccgcacactttgaatagtagtatttttaaaggatattttgggaaattagtatttaaaagaaaatcccttgtataaaaactgtctgctacagacttatctgttttgttagcttaaatttatatggtgtctttaaagatagagttatattcccattattatcaaagcagttttagattgacaaaatagtaaaagccaccagttattgagtatctgtaatgtcccaatgtctcagggagtttgctaggagctttatgtgaaaataataagaggcaataatgtattctggttgagtactccatgtggtgccggactgcctgggctcatatctggaccccatcacttactgcctgtgtgtacctgggcaagtcacttaacctctctgggtctcagtttcatcatctgcaatatagagttgttaataattcctactacataggcaggggtggatctaggctttgggaggagagtaaagtttatacaatttgcaggaccctcttgaaggaaaaaagtatcaaattataactacaaaattaggtgctaaaatgactatttatttagaaagataaagaaagcacaacaaattacacattttgacaatctgacaggcaccacaaacatcacgcatttttaggggcttgcacaagtgaggtgtcctggagcttatgttttattagcatgtaaataataatttaatttttataaaaataacagttctgcttttatggttgttcgaggattaaatgagttaattcaggcaaagcatttgcatatagtaaacacttaggtaatattagctgcttttactatttatgcacagcctagttaagtctctgactaccgctgtaatgtctcaatgtacttatttgacaaaggacaaccaggaagtcctttctgagaagtgacagctgcaacaacctactatgtgcaaagcctggattggagtgtaggtgtgccgaacaccaaagctggggctctcagcaaatccttcaaacagcaagccatgttcacttttataatttagttgaatttatttaaatgtgatttgtatttgtagctcatggcacataggtgatgtgcaatatatgctagtcataattcaaacatctattgtggtgatacatttctaattccctgaattggacatttccagatttttaatttcttacaaattctcactgagaagcaaatttttgcatttgggggggaaaaaaacaacaaaaatcaagatagctattttttttcaactctttaaaaaacaaagccagtgaaagattttgtaagcttctggccattcaataacgtctcccttatgtgcagggctggattgttgaaatgagtttgtagggcagagtgcggaaggagtatgctgtgggagaaattccagggatttggtcactcccaaagcagccatatgccatttcttgagggtggaaaggaagggtggggaagtcctgagaactgggtgatgagctgtgtgtgacttggtgttcctaactagcactttccccaagtccttggatgctcacatataaggcgatcttgcttatcatgtcatcagcgtagctgctgggaatgccagccgggtgtttctggatctgaggagcagtggagtaggtcgatttaggaagatgggggacagaggatgaagacctgagctttttttaggaggagggttctgaaccactcattattttcccacaagaaacatccagttccctgatttttcttttcttttctctgtctgtctctctctctttttttttttgagacagtctcactctgttgcccaggctggagcgcagtggcatgatcttggctcactgcaacctccgcctcccggattcaagcaattctcctgcctcagcctcccaagtagctgggactacaggcacacaccaccacacttggataatttttgtatttttgtagagacggggctttaccgtgttggccaggctggtctcgaactcctgatctcagatgatcggcctgccttgacctcccaaagtgctgagattacaggcttgagccaccgcaccccacccctgatattttataggtaaataaaataaacagggtgacttgcctaatggcagttgcttttaaaaaattttaatcggccaggcacagtggttcacacctgtaatcccagcagtttgggaggctgaggtgggcagatagcttgagcccaggagttcaagaccagcctggacaacatggttgaaaccccatgtctactaaaagtacaaaaattagctgggcatggtggcatgcacctgtagtcccaggtacttgggaggctgaggtgggaggatcacctgagcccaggtagtcaaggctgcagtgagctgtaatcatgccactgcactccagcctgggtggtatgagttgagactctgcctcaaaaaaacttaaaaaacaatctttctggaaattgtttggaattttagctgtaatatcaggtttcttcttccattaccaaggtgataggcatcccaaattgcaaatgattaatagctaaacaaacttgcagcaacattactttcaaggaagaaaaatttggggtgagtgatatagaattacccaaatgggaatattctcagactaaccgttctcagcccacatgataaatggcatctcatgtgactttccaacatctagccctttgttctgttccaggtcctatagcagatctctaaggtaattggcccttaagtttctcggtttgggtttcagcatttcagaatgcccttagaagaatggggccaggtggtagataaattccttgtacagatccctctaggaacgcatgacttcagtcagttgaaggtgtttggctgaagctggccttggtgtaatggctcttggatctgttatggcagcagtccccaacctttctagcaccagggactggttttgtggaagacaagttttccacggaatgggggtgggagggatggttttaggatgaaattgttccacctaaaatcaccaggcattagtaagaatctcgtaaggagaacacaacctagatcccttgcatgcacagttcacaatagggtttgcctcctatgagaatctagtgcctggagcattaggaggcagagctcagccggtaatgcgggctcgcccactgctcacctgctgtgtggcccgattcctaatgggccaccaacctgtacctgtccacgccccggcgatggagacacctgtgttatgggacctagagtcacggatacaatgttatagctcaaaagaagaatggaggatgcaaacctcgcctttacatctgtctttaagtcaaccgggtcattacagcatccataccaaaggtggagtgtctgtgctcaagaattaggctttgtttctctcctcctgcctcccattctttcccatggatggactctcgagatgactcaagtacctatctctcttcctccctcagtcatgatctgatgctccggtggatcctgggaagaaaaacacaacccctatcagtcaaattataaacatttaagcggcactggcaggttttttttcccacctatagttgcactaattgataacggggtaggtttggagattccacactccacagctctgatgatgttactgacacatgctcgtcctaaggaagcctttacctcaccttctgtttcctggtggtgatgttgctgggtccatttgtgttagaggcaggtgcaggtctatgaagttgattttctgaggattgttcctgtgttgaacctgattctctttcactttcttcttccctttcatcccactccaagacacatctccacagctaagctgcagccctgtcttcttcataaagcctttcacggtcactcaagagcatagtgatctcttctttcatctatttcttttgtaacttataaaactcactttgtctattgtgctttcgtgagcatatatatttttgaaaattagagagtatggtccttggtggcagagatggtggcttacgtttttctcaataaatgttgtggtctggatatcttctgttctgatgctggagaaataacctcagctgggtagcaccatctcttaagtccatgatttggggcctcaaggaagtcagtggaagctctaagatggctatttatggtagttttgcctgaagctgggagtcagttacttttctgtagccagactccacccctcgtttcttaaaaggcaccgggaaaacactcaaacaataaaaaggatcaggaattcttaactaaaaacgatgatggtattaatgtcatttgcacttccaatcctagctggcaccagcaatgtacgtgtactgggaagttttgattctgggtcaagctgagttgaaacttggactgaagtgtggccatagtgatcccctgagacatcagataggcatctcaaaaatgaaaaaccagcttctcttgttctccttgaagcatgcttattttctcagaaaacctattttacaaaagagaaaacttcaaagaaaatactttagatcaatcagggaacttaatacctgagaggggctgggctttccttctgaccatagttattttaagtggtccccaggctgctccacaatttagggagggaagggcaagagatgatcatgcaagactgataaagaacttgcccagggtccctatgatggccttcctttcacagtctcttgtgcatctcacctcattttattttatttaattaattaatttacttttaatttttatttttttttgaaatggactctcacattgttgcccaggctggagtatagtggcatgatctcggcccactgcaacctccacctcccgggttcaagagattctcctgcctcagcctcccaagtagctgggaatataggtgtgtgccacgacgcccagctaatttttgtctttttaaaacagagatgaggtttcaccatgttggccaggttggtttcgaactcttgacctcaggtgatccactcaccacagcctcccggagtgctgggattacaggcatgagccaccgtgcccagcctcacctcattttagaattccaaaaccgatatactcctaggaagtgtttggtttgtaaaccaagaataaaatttgaaggcccgccaaccaactgaatggacttcctcctctagtccagggccctctaagtttaacctgaaagactggttcagaccgtcacgggaagtgggggtctgggaagtgggggtttgacatgcctccttgtacccctccagcatgaacatcaacacagatcttaagtctgataggaaacatttacagtcgatgccctctaaagcctgctacctgggggcttcatctgcatgataaaattttggtctccacaacctcttattataacccagagatttctttctattgataataactctttcaaccagttgccaatcagaaaacttttacatctacgtataacctggaagcccccaccaccttcgagatgtcctgcctttctggactgaaccaatgtatgtcttacatgtatttgattgacatctcatgtctccctaaaatgtataaaaccaagcagctgtgccccgacaccctgggcacgtattctctggatcttctgagggctgtgtcatgggccatggtcactgatatttggatcagaataaatctcttcaaatattttacagagtttgactctttcatcaataggttcttacttggagtcagggtggatgtcagcctaaatcctgtactatttttctccatcccatgttctattgaatagtagactctataatggcttagaatggcaacttacaatgtatatatatattttgggtggggagataaagcagggaatggggttaaaagagtttctcttatacttttagtcttcaaaatggaaatatctgcattttgttaagacttgaggtcatacagaaaagtttaaagaacaagatgtcaatcaaaggtaacagccattgattagcactttgatgcacattctatacataaaaacacttacacttacaaaaatgggatcatgttacatatagtgttttgttacctgatttcatcacttaaaattgtgtcatgaacatatctctcaggatagactaggttacgctgtggtatccggcaatccccaattctcaatgtcttaaacaacaaactcttatgtcttgcttatacaccttgtccatcttgggtcagcagtggggcagctctgcacctgttggtcactgtgaacttgggcttcatggagcagtcattaccccaaacattactaattactgtgctgaagaaaaggcagttctgggacactgaacattaacttaatgcttggctcagaagggactaatgttacttacattcataacttattggccagaactagtcacatgaccctgtctactcacaaggactaatccctctggcagagagctaggaatatatttggagaacaacctcgaagtccagtaaaatgaatgttgattcatgttagtaaatgtaggtgcaggtccttattttcagtagctgtgtggtaattaatcaatgtatcatagtctacttaaccgaaccacattttcagggcattttaggctttttctaattatgagcaattgttttaaaagtttccaagaattttcttttgtgttcattttttttttctatcagtattttcttcccttttctgtaagtagaatttataaattaaaagattgcatactggtgggaatgcagaatgttacagccactttggaaaacagtttggcagtatcgtaaaaagttaaacttggccaggcacggtggctcatgcctgtaattccagaactttgggaggcagaggcgggcggatcacgaggtcaggagatccagaccatgctggccaacatggtgaaactccgtctctattaaaatacaaaagtaaaattagccgggcgtggtggtgcatgcctgtagtcccagctactcaggaggctaaggcaggggaatcgcttgaacccgggagttggagattgcagtgagccaaggtggcgtcactgcactccagcctgggcaacagaacaagactccgtctaaaaaaaaaaaaaaaaaaaaaaggccgaacgcggtggctcacgcctgtaatcccagcactttgggaggccaaggcaggtgaatcacgaggtcaggagttcgagaccagcctggccaacatggtgaaactccatctctactaaaaatacaaaaattagcggggcgtagtggcaggcacctgtaatcccagctactccagaggctgaggcaggagaatcgcttgaacctgggaggcggaggttgcagtgagccaagaccatgccacagcactccagcctgggcaacagagcgagaccgtctcaaaaaaaaaaaaaaaaagaaaaatagacatgaagtctaggcatatttcttatgtttttgatctacattgtaaaactgccttccagaaaggaaggaaaacttattactcccagcaacaatagtttacacttctattagttaatgagatttgccatgagtaacatccatataatcagctaagacctttaaattagtccagagtgtctagttaattaattattaatgagttttttttaaaaaaaatcttttggctgggcacagtggctcacgcctataaatctcagcactttgagaggctgaggtgagaagttcgcttgaacccaggagtatgagatcaacctggacaacatagcgagaccctgtctctacaaaaaatacaaaaatgaccccgatctggcggctcatgcctgtagtcccagctgcttgggaggttgaagtcgggggatggcttgagccagggagtttgaggctgcagtgagctgtgatcgcaccactgccctccaacctgagcaacacagcgaggccatgtctaaaaaaagacgatttcatcactttcccgcatccctccccggcatgtggaagcatataagaaatcatccagaaaagacaccatgaagaaaattcaagataagttcagttttgcttccagagtttcctggagttttaagttgaatagtgagcccactggaattaagactgaatacctttacttactgtaatagacacagtagcaaagagtttaacttgaggccccaaataaaatgaaacagaatacaaatactctatctttttgttcttgtcatttcatccatctcctcttacagatagaagaatgctcaggcgatgagatagtgtgacattatgggttaagagtcaaccagatctgacagggatgaattctaattctggcctcgaaacaaactccctgataaaaagtcaaaactgcttttcaggatagatacagcttttggtgaatctgaatagattttaacccccttgtataactcatgtgagaatgacctcacaatcatatttcatgtctcttctcttttaaaaatcacctttttaacagtctcttctcttttctaggatggactcagggtcccgaggcaagtcagactgttgcagaggctggtaggtatattcatggtgcatcttgaaagtccattccctcattcttctatttattttgaaccaggtatccactttgcttgcagatcctccaaaacatataaagttgcttgtagaaaaattctgagatgaaacagcatagttgagtcttttataaggctttctttaagtggattttttttttcttttttctggaaggagacctgattatttcagtagaactaaaaacacaaaggtctttgcaggtttattttttttaaagcctaaatataacttttatttatttttatgacatccttactcaggaaatgagagctttgttgtgaagtaaacaactaaagcaaccaaagaattgacatttgtagactaaagcatcacgtgatgaaagttggataggctctcaatgctgctggaggctaagagattgggaccggggcaaatgttcagaagctctaagagcttatttgaaactacctcagttcttccttaccactgtgcatggagtgaaatatcaaaatgtagagacatgcctttagactctggtgaggcatttatcctagccctccctgcacctggctggtgtttgagtggattcagatttcttgtcattaccaatatcacaatcatgactatctttgtttggattgagattttgaattaaaaaaaattttttttttgcttggttttctcatctcctttccttcttctgatcctcccaatcttacctccccataccccaaattcatttgcctagtattccttctttcatgttttctccatgttcacataatcctagacaatgacatatgtacctaaacatgtcaagaactgtgaaggggctgagattaaagctacttacaagctaataagctagtttgttaccatttcatggatactagcagaaaacaggagactcctgggtcagagacaaaggatgatttattactcacagtaatagcagtagtcaaagcatgtgtgccattcccctggttcccagaaggtgatagacatggccagatgacacctgccatgcagttggtttgcattgtgtgaaaggagcccttaacttagggaacgcgactctttaataatgagcactaagcctgcctggtctttgctcctggagggagatattttctttattattctgcacattaagccaaactgtcttcttccctgaagggggaacctgtcttctgaggctgttcactatacgtttgtaaaggtaattcccagcaaaggcagctagagtctctgcttgcaaattgtgcagaaacaccagagattcatggagaatagcctcccagcaatacatacatacatgtaaattgtaagcatactgataattgagatgatgacaagtgccactgaaaaatagaatgcagcaggggaacccgaggcacatttgcatatgggagacctctgatcattgctctaaaaccatgggtgcatgtgacggctcatgtcaaccgaatgcttacagagtctcactcttgttgctcaggctggagtgcagtggcgtgatctcagctcactgcaacctctgcctcctgggttgaagagatcctcctgcctcagcctcctgagtagctgggattacaggcatgcaccaccacacttggctaatttttctatttttttagtagagatggggtttcaccatgttggctaggttggtctcaaactcctgacctcaggtgatccgcccacctcggcctcccaaagtgttgggattacaggcgtgagccactgcatctggccctcaattactcttataacaattatttgaggcattttacagatgagaaaacaaattcagagagagtaattttcccaagacgacacagctgggaagaggtggtagagccaggatttgagtccagttcagtgtctgagtccatgctcttaactaatacaccaaatgggcctctcagttatatgtatttaaatctgtatttatatgtattataatttactaaactttctgttattgatgaactctcaatttatttccagattttttcaccctgtacacaatccttcaaaaaacactttcatttcttcttttatgtgggtatttttaattctacgacttacaattcaaactgcatatacattttaaattttgccaggctcgatggctcacgcctgtaatctcagcagtttgggaggctgaggggggtgaatcacctgaggtctggagttcaagaccagcctggctaacatggtgaaaccccatctctactaaaaaatacaaaaatttgccaagcgtggtggtgtatgcctgtaatcccagctactcgggaggctgaggcgggaggattgcttgaacccaggaggcataggttgcagtgagctgagattgcaccactgcactctagcttgggcaacagagcaagactctgtctcaaaaacaaccttttttttgatagatgtcagattaatttttgaatactattactcttaacactatctgtattcataccatgtctatcagcaatgatgaatacacacatttctgccagcaactgatataattactcttttaaatttgccaatctcttacttaggaagtgatatctcattgttcctttaacttgcatttccctgcctatgtacgaatttggaatttttttcttttattgctcaaaccattctccataacaaggatttggacattttaaattatatttgttagccattcagagtcgttctcctgtgaattgcttttttttttccaggtcctttgcccatctttctattgtgttttttatccacctcattgtcaatttatcagagacctttgtatgtgatagataccttctgtcttctaaactggaagaatgcctctctgaatctatcatttattaactttctttctggtatgtttgccacataaaagtgctcagttcctaagtaataagtagtttatgttttcctttcaaaggaaaggaaaaagaggctttgtacacgtagcctctaagggtacaaagattttcttgactccttagcttagaccatttatataacctcttagattttcttagaaatttcttagaattttgaaagtcttacttttacaactatcataaatttttaacatgaactttactgaccatccagttggtactagaatgatttttccagtggtagacctggcgcatcactctcttgcgtgcatgtcttcagtgactccacatcacccgtgggataagctccaaggatgtgtgaaaccctgcgtgatgcgcctcctgcttgcctctggagctcagttcatcctatgagtctccttctagcctgcattcttgccatctccctccagttgtcatcctctgaatgttccgtgcttgaattaatgaatagaatgtggatggcaacagctggtactcccgtaacactgccaggaccacaggaatttgtttgattttattctgaattaattagataccctttttatgaagctccctggcatacatacacacaaaatatttactctttggaaagcagggggatctttgtgtgtgaatttccatggtgctgaatggatcctggcctgggtttcccaagaggattcgctgccatcatttaacctcctgactgcagggtctgtcttggtgtctgctttgcagcaggtgttctacagtttgtgctcagggtttgtttctattgagtgtggtaagatacacagacagagaaatgactgacatgaaggaggaatttcatactcacagatccctggaggcaggggcagcagcataccatgccaggacacatggggaagcaccatggtgggtcaggggcagaaggtgcagaggacagtgtgtgtctcagagcctgcattggggttttcatgggaaggaatgggcaaggcagggtagtaggtaggctgaggaggtttaggattggctgtagggttggtctctagttgtcaggtacctggtcctggggagatttagggtagggggagtattggcttggcgcatgagttttatttattattattgttattattattattattattttgagacagagtctcactctgtggcccaggctggagcccagtggtgcgatctcggctcactgcaacctccacttcctgggttcaagtgagtcttgcgcctcagtctcccgagcacctgggattagaggcctcccgagtacctgggattacaggcatgcatcatcgcgctcggctaattttcgtatttttagtaaagatgggtttcgccatgttggccaggctggtcttaaactcctgacctcaggtgatccgcctgccctgccctcccaaagtgctgggattacaggcgtgagccaccgtgcccagccgaggtgcatgagtttgatatgggagatggttggatgtgtggctatggattggtcggtttatatatcaaaggtatgcttgcagcagggttgtctgctgttcctaggaacaagccagccctgggagggacggtctttccaggatcaaagccccaaatgccagagcatcaagaatatagaaaacaagaaaatacagtcaatacagcaggtagcatgactctgggcatcatacctcattgaggaccagtcatatgtgtgtctgtgcctgtgcccaactctgaccattgtgtgcatcctgttcaggaagtgtatagaatggggcgggggagggggagggttttcttgtataaaaataaaaatggcattttgttttccttctcccctaaatataatgaaacatcactacgtagactgtattagcacaagtaggtgattcagaaccgatgccatttcctgtctacagaggggtaaaatgatttccccgaggtggtaaatctagcagttggggaagtgcctttttctcctgtttcattcaataacaacatgggctgtatttttttttttttttgagatggagttttgctcttgtcacccaggctggagtgcaatggcattatcttggctcactgcaacctcctcttcccgggttcaagtgattctcctgccttagcctcctgagtagctgggattatgggcacccatcatcacacctggctaattttttgcatttttaatagagacggggtttcaccatgttggccaggctggtctcaaactcctgatctcaggtgatccaccagctttgacccccaaagtgctgggattacaggcatgagccaccacgcccggccctgtattgtttttctcagaaaggagaagcattaagggttagtagagatttggtgcgtggagtcagccaactgccacgctccagccttctctctaaaacaaaggggagcagagttagatgatttctaaagttctctcccacctccataatgacttctcatggttgctaaagactggttagactgaaagaaaataatgaaaggttaatcttctaggaagaggcactgtggcctgagtgctggcaaaggccgtcccaaccatttctccaccacatttccagatggcatcttgggtgactcaggacatcctcgggtggcttgattttaagtgcctcacatgagtcatacccaaagcttgggtcccttgagcaattaagacactccctgcctcaaatgacttttccatctgtgttgcctttgtaggaaaaaataatgaagaaattatcttatgtcacaggaagattttttttaccactattttccagcggacatcccaaaacaaagttatgacttaaatagaaatatggaaagcatgttggatttttaagaaccgtgcactgggaaaaagtgaggccactgttttatatccttcctttcatgacacattttcatgagcctctgcctttcaaaggcctcgcttgttctttagggttgtctgtttcctgtgttacctgcctgtccaatattcttctcacagcatgctctcttttctagtcattgatctgggaatgtgctgtgattcatttccatttccatgtcttccgtgttcttagagtgttctttctgttctctttcaccacatgtaaatactacatctgttttaaaacattttcttacttttgcagacctcactgatttatctttcttctcaacactggaaggtcttatagtcaaggtatctatctatctatctatctacctacctatctatctatccatctatctatctatccatctatccacttacccattcctatatcccctatctctttagacataaaagattagatttcatatatatatatagttttcctctatcttgagagctgtaggtaaaaaaagaacaacatgttaagcactattatgtctcatgatctaaatagaaactctttctaatgcaaagaagaaggaggaggaggaggggaagggaaagaagaagaaggaagaagaaagaataagaagaagaagggggaagaaagaagaaaggaggaagaagaaagaaggaagaagaaagaagaaagaggagaagaaggagaatgaaaagaagggagaagggaaggggaaggggaaggagaaggacaacaggagtaagtagtagtcatggcttctgttcttcgtgtttacaatcccataatctaccagggcaggggtaagggttggtaactgggagggggatagactcgtgcctaattgaatctagtagattctgcaccaaggaaactgtaagagaagggccaggctgtggtatgtcagtaagagcaggggctcctgggagaattgtagctgggcagaagcacaaaaactaaaatagtttcttgaaccttttttcagcctgtctcttgggcccataaactaagcttcatattcttgatgtaatattgtggaaaattctactaaatctatacacttaatttaaggtataagaagataatgtgataaacttaatattgtcaggtatcttctagttttcacattttaaattaaatgaaattatttcttatctcataaataagaacaaatcaccatgacattaaaaatattctcaagcatactaagtgaagaagattttgatctattttaaaaatactactgagcaagaactattagcagaaggagctaaattttacttggaacagtgtgcagctacagctgtaaacttctgcttatctaagatgtcaacttaatactctcccctcactagtattctacttttatgtaaaagaattacatgataaattgacaagaagaatttttgaagtgtcagaatatgactacagttcagagaatacattcagtttaatgtcctctatcttcaatgtgtacaatttaatggatgataactgaggttcacaagtaacttttgaattagcaccaaagactgaattatatttactatacctttggagttctatattttattggttatcaaacaataatcactgcgaaaaggcttgaattagccagggtgtctctgtgttcttttttttttttttgagacagagtctcgctcagtcgcccaggctggagtgcagtggtgtgatctccgctcactggaagctctgcttcccaggttcacgctattctcctgcctcagcctcctgagtagctggtgcccgccaccatgcccggctaattttttgtatttttttttttttttagtagagacagggtttcactgtgttagccaggatggtcttgatctcctgacttcgtgatccacctgcttcagcctcctaaagtgctgggattacaggcatgagccactgtgcccggccactgtgttcttttttgaaagagacaggattggaaatcgaggctttggatggccattggggttgactaccttttacctgtgtgatctggcaaagtcacacagtgaatgactttggcctagactggaaaagtgaagagtttatatttaagaagctctttttctttacagtttatcttcatagtttaacttcttccaaaaaaatttcaagcatatttttaatatgctgaaagtttagtttacaaaacataacaaagtgtgtaaagatcagaaatgacatagagttggaaataactaataaaataactaaatttcactcaccagcagtcacactgaagtggggttgcaaactcgaatgtctacagagactagacaggtgttcacgttttctattgctgcacaaaaattttccacaaaattcagtggcttagagcaacaacgattttatcccatcatttggtggggaaggatttggacagagctcagctgggtgattcttctggcctgtggtgttgctggaggttgctctggggtgttcagttggcagatggctgctctggagggggcagtgcagcttcctgcatgagccgggctccttggcaggagcagctgggctcagctgaattattctccatgtttttcctgccattgtagcagaaaagcagccatagacagtatgtaaatgaatggatgtggctgtgtttcaataaaactttatttacaaacagtgtggcctgcctggcatagcttgcctactcctgctacagatgaatgagagagcagggacatctgaaaggactttccaaaaatgatgaaaaatgattacaaatggatgatggatgatgggagaactggttaactaaaatttaatgcatccataaaatgtaatactatgcagctatttttaaaaaggaaggaggttgatattttttgttcagtggcagattgcattttccaaagatggcagcacttgaatgtgccattcctcccatggagatgggggtctgtgccctctgcctttgaaactgagtgtgcctttgtgcctgctttgaccagtagagtatgatagaagtaatgcattgtgatttttgaggtcagggcatgacagggcatctagcttccaccttgctgttgggaaagctaccaggtgaccggtaaagcctatggctaccaggtgaccagctgactcatgtgtagtggcccatgctgtgagttcatctacacttgcccatttggaaggactatatagaggggattgagggacaacatgagatagagagatgccagccttggctgcctcagcaactcacaattccagcttcagccaccctttgtagagaagccagacctcccagccaagcccttctggaattcatgacccacagaaaccctgagaggaaacataaagattgctgctgttttaaaccactgagttttagagtgatttgttaagcagcatgagatagctaagacacagataaagaaagatgaactaactatatcactaggtgagattaagcaaattagtacagtatatatttatggaaggatatacaaaagttgtcaaacattgtctctgggaaatggaactgtgaatccagggtgggagggagactgctattttcattttatattcagcataattagaagtttttaccatgtgcatatgttacttgataatttttaaaacaccagtttaaattttaaataaagcagagaatgataaagctagaatatactgagtttgtgggattttttttaaagcattgattcctatttactttcccatgcatctgtagaaatcagagctgggtgcagtggtattctagatgcttcgcaaattcacaagatcacagccgtggggcatttcttatacaccagtttagatttggagataaaagaatatatttaatcatggataatttagaaagaaaacctgttccagaaataacacagatcaaagtaaacacttcctctcaattcatggtcttattcaccttggggttctttttttgaaagataatgagatacaaattttaactttaaaaaaaaccccacaggttgtcatgctgttaagatcattatcattatcatccccagcctaatcctcattgcctttactgaaatgtatgaaatgtttttaatgagatcatttaacagaaacatttggtgaagctacatgttggagtctcttttttaatcctaatcgctttggaggagagagacagattttgtcctgaagagactaggtttccattaaatggtactgtataatacagcttctcaattcagacataatttcctaaacccaaaggttttattcctcagttttagctttgccgtaaatctgtggatcacagatgtggatgtaattttggtgatttattcaagcccttttcacttgcagatgaagaaatatatattttaaagttcaattagtaaaaagagacattctcaagcttgatcaggcattagaatgacctgaagggtttgttaaactgcggcttgctgggccaccctctgagtttctgattctgtggatttggatggagtctgagaatctctagcaagtttccaggtgatggtgatgctgctggtccgaggaccacactttgagaagcgctactttgaaataattccttctcaaactaaactggaaggtttcttttcctcttttaggcaaaactctttcaacaatactcagattttttttttaaacttgatcattacttaaatgaactgtaaatgtttatcccttctgtctctctaagaaagatgcacatccccctaacgttttcgttaagctgttccatttgtctctggcttttttgaattaccaagactggaagttcttgcacagtctgctacaaagatgaatggccctgacacctttgcatggagtgcttgcccattctctccccttcctcatgtgcttggctccaaccattgcagctccctgtcttggtgttcaagtccatcctcaggtgtgcttgatatatatatatatatgtgtgatatatatatatgtgatatatatatgtgatatatatatgtgatatatatatgtgatatatatatgtgatatatatatgtgatatatatgtgatacatatgtgatatatatgtgatatatatgtgatatatatgatatatatgtgatatatatgatatatatgatatatatgtgatatatatgatatatatgtgatatatgtgatatatatgtgatatagatatgtgatatatatgatatatatgtgatatagatatgtgatatatatgatatatatgtgatatatatgatatatatgtgatatatatgatatatatgtgatatatgtgatatatatgtgatatatgtgatatgtatgatatatatgtgatatatgtgatatatatcatatatatgtgatatatcatatatatgtgatatatcatatatatgtgatatatatcatatatatgtgattatgatatatatgtgattatatatgatctatatgtgatatatatgatctatatgtgatatatatgatatatgtgatatatatgatatatgtgatatatgtgatatatgtgatatatgtgatatatatgtgatatatatgatatatatgtgatatatgtgatatatatgtgatatgtatgatatatatgtgatatgtatgatatatatgatatatatacacacgcacatatatgtacatatatatatatattttttttctgtgacagggtcttgctctgtcacccaggctgaagtgcagtggcacaatcttggctcactgcaatatttgcctccctgcttcaagcaattctcctgcctcagccacctgagtagccaggactacagtcatgcaccaccacacgcagttaattgtatttctagtaaagacggggtttcaccatgttggccagactggtcttgaactcctgaactcaggtgatctgtccaccttggcctcccaaagtgctgggactacaggtgtgagccaccgcgcccagccggtgcacttgatatttgtagccacctctctaatacatcatagaaaatgtctctcaagcttttggtggtttgtatgcagatcgtgatttcacgcaaacattttgagtgcgtatttgtttaaatagaataaccctctgtagtaacttttttgaagcaaggtttgtgatgatctttgtatgtcacagcaggaatatgtctttgatagcaataggtcgcaaccttatatctgttttgaaaacaggcctagggctgtaaataaattaataaagcagatgagggctgaaataaacattgcccagctaggtgacagttcctgaaggagagagtagaatcttatcagagtaagccagttgcattcaacatgttttgagagcctttgtgtgcccaggaccagcatgggggttgagcacacaattatgagcaggacgtgtctgcagagggcagccagacagtctcacataatagtggccagttcagactttgaagtaagtgggatcgggttcaagttccacatccattacttgctggcatggaccaatatgtgccctcactaagcttgacttccctccatctatgaaatgggaataaaacacctactgcgtatgtcttcaaagactgtcatggggtaatgtcttgttttagcttgctcgggcttccataacaaaattctatagaccatgtggcttaaacagcatacatttattttctcacagttctagaggctggaagtccaagacccaggttctgcagggtttgggttttgatgagggctcttgtcctggcttgcagacagctgccttctcaatgtgtgcccacatggtctttcttggtgcacacacatggagagagagatagagagctctcttatgtctcctctcttaagggcattaatcccatcatagagaccccaccttcattacctcatctaaatcaatttctcccaaaggcactcatctccaaatactgccttccccgcaaccccaccacctcccatagtaggttagggcttcaacatgtgtattctaggaggacacagcccataacatgcttgttaattgcttgaccagttcctggagttagataaccactctgttagcagtggcttgtggctttccttacaaatgttttcttccttcttcaggcctctgctaccagctgtcaccagatgtagctctgttgtaaggactagaaaaagccctgaagagttttaacaggcttttacatttgcatcttctagttactgctctcatcaggggcttttgggagaaatttaattagcacagacttatgtgttcctttttctgggttctaaattctctagatactctgctgagttcagtattgattcctatttcacagtaatgcgcctgtaattcagatagggaagctctggtgtatcgtttctctaagtggacattgaaagtaattttaaaatacgagatttttgttagtcatgttccggtttttggaacatttcggtagtcctgtaaatgtgatataaaagtgataacagaagagtattatatacagcacatactttacttctaaaattccgatgattgaactgtttaaggaacgtgtattttctgccaaattggacgtcttcactgtgttcacttgttaaagtcaggttaaaagatttgcttgtgtgttattaattgtttatgcaaaacaaccaaggttgttttacaaaggaagggagttaaaaatggggaaatcaggaaaagaagaagaaaggaaattggaatcacatgccaaaggctcccaaactgaagattatttcccttgtggaaaaaaaaaaagatgttccactaccaccaaaatgctttcatgcatcaccgatgatactgtgtgttttcattcctacagaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgtaggtgacacgctggtcagggatgaagatttctgcctagggtggtcaggttgagcctgagatgtgaggtccacagccttgtgactgtgaggatttatattccagtagatggtatatagatcagaaggtcaattcttttgttcaaattcattggttggttcattcattcattcattccttttcttcttctctttttccctccctccttccctccctctctccctccctccctccctccctccctccttccctgcctccctccctccctccctcccttccttccttccttttctttccttccctcctcgtctctctcccttccttctattttctcttttttattcaatttttttcttcctttctttctttcctctttctttctttccttcctccccttcaacaaatgaatgacctttatgggccaggttactcttcatgaaaactggtgcacttctctgagaaagacagcctcacagtgctgcacaaattccagtagggagaaccagtcaatagataaatgaacaaagaataaatgagatgaatttcagacagttgcaaatatgataaagatggcaagtcagaccaagagggtcttcttcagttagggagatctgggaagagctttcaggaggctcttcctcctccatggtgaagttgagggttgaaagacaaggcagtgtagaacctttgatatactagattggatatctttcctccttctctgagccaagaagtaaagatatgtaaaacgggctaggtgttgggtttaatttttggcccaggtcagatgtaagttggtgaatcttcatggtagtgtgagcagatcttgtgacttttctcctggagaatcacagaggcaccatgggttgggtcttgctatttggacctgttgaaaattgccctagaataaaatgaatgattcaaaggtagtgccctagtctggaatgcattctttctacacatccaaaaggcaaataaaaatatttcctggggttgtcatggttataagatccatgtctgaatttgtcttggaactgcaagctggtagcacaactgtctcttgtatttcaggcttattggagacaaggtgtatcagggcgaaattacagagagagaaaagaagagtggtgatagggtaaaagagaaaaggaataaaaccacagaagaaaatgggtaagtattggttaattaaggaattaaaaacccattttagcaaagtgccacattttctatgcctttgcctactcctcttgtcgtcttcctttcctccaaatacttttctctttcttttttatcaaaatataaatacatctagtgaataatatagtagataagtgtttgtaataaaaaggagaattttaccatatttatctctcatgctcacttcccacacatatcctcttctaatatttctatatgtagtttgcagttttccttttttttttttttttggaatgaggtctcactctttgcccaggctggagtgcagtggtgcaatcatagctcactgcagcctcaacctcctgggctcaagtgatccttccacctcagcctcccaagtagctgggattacaggtgtgcaccaccacacccagctaatttttatttttattttttttgtagagatcgggtcttgctacattgcccaggctaatctcaaacttcggggctcaagcagtcctcgcacttcagcctctcaaagtactgggattacaggattacaggtgtgagccactatgcctggcctgtacgtagtttttttttttttttttttttttgtagttaccccctaactctaaatattgtgatagtcatacttcaaaaaattttttttgataaaaataagacattatctgttgactctttgctataaagaaagggtatttagcaaattaacaatactcctacttttactctgcattcacatttttatattattcttttatttcttcttccatcaatccaacagtgtttagactatcttggactatccctactatcttaaatgattatattccctctcctaacctccactgtctctctcctttctcatttcatgatgttacctaatcattgtttgagttattagcatcttaattctgacttgtaatacttttattctttcttttgtttataaatggaatctaaacattgaaaccaatacatagcaattgctttttaatgcctatagaaataacatgaactgcatgcagagccacctagtacactaagattattttttcctcttcaccagcccaatgtgtaggccttcatccccttggcagaaaaatgatctttgtatctagataaaatggtgtgaacctggtaacccggttttcctcatgaataaaaagacatcattttgagaaatttagttctctaaaattatagactgccagaaactttgctgttggaaattttattagtgacaagggaatgcctcactcttgtctggaggacatgagccatgggttcactttgatacagaaaagcaaccaaggtccagagcttcagataagggattttcaaaggcacaaaattccacgtttatcttaatgtcgtagtttctaaagacatagagaatctttagtctgcttgtcagtccaggcggaaatgatggttttacacacagcctttgctttgagcctgtctgaacactgctctatttaaatttaacctatactccatccttcccctaattctataaaaaccctgtctctttctttgtttgatgagttgcctcatcgtgcctctggtatgtggtctcccttgctgtggcaagttattaaaacctaactctgttagactatagatttatcccaagtggtctttatcacaattgttcagagtcacactacagattagtttagttgaatcatgacatatgtttctgtttttcctggagtttctaactgcttttcttttttcttatgatataaaatgatataacatctagcgagacacataaccattatttaaaatatgttatgatttaacataacaaaatgaacagctatgaacaagtttctgcaagcagtgacatccttatcactcctgatatctggccaacagcagctgaaagacatcactgattgggagacattctgatttcagagcttttaaaacatggatgtctttatatccatgaaatactttcattgcttttcagccttgatgcaaaacttttaccctggtatctcttttcgtattcttctgggttggcttttttatttcgtgtattccacattttcctctttcttggctttcacctttattttgcagaagttatattctgaagtaactttctcagaatgggtgcatgagaagtaaactttctgagaccttgattaatattttggctgtgtatgactttaaggtcaaaatacttttccttttgaactttgaggcattgctccaatgtcttataacatccagtagtattgatgatacatctaatgggaccagataacatcacttttacgttttctctgtgtgatgttctgaagttttacaatggcgggtttcggtgtcagtctcttttcattcattctgctcagtgcttgaatttttccatttcaatacttatgtctctttccagttctgggaaggaggagtatagaaagcctatcagcttagtcattcattcacattggacttggaattatcctgtctatactgggtctcccttttcccttccatcttgtggtgtcctgaattcagagcctgcactctctctgattctgccacacagttgggttctctcctttgctgcagccctttgctgcatgttctgagctataaaattcttgctctactgaacaccccaagccttctggaaacttcttgaaatgtcttacctactaacggttgccactcccacttattcctctagtgatcagtctgccattttgaataagagaaccctcactccaagtactgaaagcatctggagtgtatttttgtcagctttggagtcctttattccctacctttcctgctaaacatatccaccaaactttaccaagatgtgaaaacctagtatgttagctattttaaagttatgtaaaatgccaagattcattggccatccttgtaaagggagagcacaattcacagcttcactccaaagctctctcttctagcagttcacctactcaacgtcctttcccattgctcccttgggtctgtctcagggagaggtaggacagtattcttagaatcctctcctggtcggtattctttgacccttcgtgacctacctctagcacggggtttcacttcttctaatacgaatttttatttttcctttctcaggacccacactcacacccatgggtctccctggcaggctggttgagagggtatggctggtgccctgtggggactgagggaacctggctctatcctcttccgaacctccctggggtccttttcctttttcctgacagagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaaggtgagtcctgcgtgctgggttcgtgcagatctgtggtgaaaacacccagctggtccttggcttcggagaaatctgcaagagatggcacccttcccttcagcaaagcctttgcatttttgtaggaactggaatgatagcaatgaagctaagacagcaactggtactttttttctttttttttgagacgaagtcctctgtcgccaggctagagtgcagtggcgagatctccgctcactgcaacctccgcctcccgtgttcaagcgattctgctgcctcagcctcctgagtagctgggattacaggcatgtgccaccacacccggctaattttgtatttttagtcgagacggggtttcaccatgttggtcaggctggtctcaaactcctgacctcgtgatccacccgcctcggcctcccaaagtgctgggattacaggtgtgagccagcgcacccggcccattttttttttattaaaaataaaatacagcccatgctgtaacaggagattaaaaatgtatgagttattgatgcaataataccacttctggaaatctatcctaggtagaacatctaacatattgggaatgtcatatgcacaagctcgtttgataatatttgtggtagcaaagacattccatcagcctaaagattcaattatatggaagagattagtaaattacgattataaaacaattcagcatgtggcagagaagaaaaggcaaattgtatatgtactataatgttaaatatgaagctgataaaatactagaaagttatagaaaataatcattttgtatcaggggtatgagattgtggggccattttctaaaaatctgttttttaacattcagcaatatgttatattctttctaaatttaaataatgaaaaatgcttagtatagatgtaagatacaggcatcttgattcattagcagaattattctgatttttaaattttctcaaattctgatttttaaaatagctcttcatttattgaaatgaaaaactacagtataatctagttttaatcaccgtattttttttctttttttgggagggggctttctggttttcacaaagtctaaaagagtgactttagttactatatgaatttcagctaatagtatatattaaatattgacttgtgttgggctgtatacttaatataccagtaaggctggtcagtgttgaattggatgagacaggaatgttcaaaaattgcaccaggactggaattttaagatttcagagaattgtgacattgagagtggagaaatggtaaatgatgagcagagtatgtgcagaatctgtattcagtgcctgcggctgcacaatcatagaatgacccaggaagtcttcttggaccagggtatttagggataagatcggcaggagaagagagagagcgttgcctggacaagcggaatcagagaatgttggtatttaacataatgcaaaaataaccaaggcctagagctggtggtctatggaggggcaaacagtgcggaaaatacactttctcccccagcatgcagttgagttaatgactatgtgagaggccattcactctcacagactgagcgtttcctggctctgcgagagacccaggtcctttgttatgtgttggactcaagtcctttgttatgtgttgactccaaacaatgagcttgacattcttaatccagatctagctggtatctagaaaaagcaaaaatattgtcaaggtacctggcatttagaaatggcatgagatccaatacaccattcttaggtcatgcaggtggtagctgtatggttaatggattttagttcagttgttaattgtaaccttgtaaaaaatgcaaggctgtaagacttggcttgcacatctgggaaacaggggtaataactagctcatgggtcattgtgaagtgctcatgtatgtaaagggttggccgcagaatgagagcttaaaaattattactagttttcacattatattgacttttttctgttgcaaaacttacctctgtaataagatcattggtgccttcgaaagcaggtctgtttctgattaacctgtgtctccttagcacttaacataatgcctgttaaacagtaggtagctaattgagtgtcttcgaactacagaagaaaagcaggccagggatggtggctcacacctgtaatcccagcactttgggaggccaaggtgggaagatcaggagtttgagaccagcctggacaacatagtaagaacttgtctctatgaaaaaaatagataaataaataaaaagaaaagcaaacacaaataactaagaatgttttaaaatttcatttctctctaacagtacctcggaagaaaattttctcatgtgcaactgtgggaaagaagtattttctcagggggcagagttgtcaggatctcgtaaggagggtagagtatctgtgaagtgtgtctgggatgagaacacattcagtagctgtgtcagcagaaggttcagaggggagtcctgttgcagtaatgaaatgtgttttgcctaattttcagaatcataatgactcttcagagatgtgtacgtgttgtggggtgtgtatgtgttttgtttggagggagtatgaattatgactgttagctaaaaaaagttgcttactgtttatattcggggcctgttagtgtctcagaggaatttttccaaacggttgatctcttgggatctgtttgtttttaaggaaattgttttcttagctccttgtaccaaagcagatactttgccgtccagaacatgaagcttttacaagcatgtcccagagccaggtgcagtggacggattccctttttgctgctccccactcccgtctttcagagctcagcggttattgttcctgcaaaatggcagccttagcagcttgaagcacaggatgttgtgattttgtctggacagggctgtgtttttccagaagaaatccaggctaaagatcaaactggaattgggcttgcaccaaaactatgattgtgtgaatgaggtccaagccaatacattccgctgatagatctggctgtgttaagaaatctaacttctggaatttgtctaagtaaatctctcaccatggacccgttttctttctcttttctttcctttttttttttttttttttttgagacggagtcttgctctgtcgcccaggctggagtgcagtggcgcgatctcggctcactgcaagctccgccttccggattcaagccattctcctgcctcagcctcccgagcagctgggattacaggcgcccaccaccacgcctggctaattttttgtgtttttagtagagacgaggtttcactgtgttagccaggatggtctcgatctcctgacctcgtgatccgcccgcctcggcctcccaaagtgctgggattacaggcgtgagccaccgcgcccggccaccacggacccattttcatctttaaagatgcaattctagatgaggattactactgtgtgctagatactagactaagcacttgcagagtgtattatctcatgcaatttttataacaaccctcttagcttttttttttcaatccccattttaattatgaagaagctgagaaaccttacttactaaaacagaggttcagtaatatggacaaggtctcatatttaattatggatagaaatagaatttaaacataggtctattttattccaagttatacccttaaccactgcactatctacctcctcattaaatagactgtacattactgtgggtggagttcaaattccaactctcttcctaaatataaaaataaaaagaaaggctaagagcaatacaatccacctttgcctcagtttactttatgatatatcaggattgaacccacatctgttgaattgtaaattaatgggatctttcccagtgtaaaaggcaatcctgtgagacgtattttggaagatgaaacattataatttctgtttattaaaatagttaacacaggtacgtggttgaaaatctcaagcattacaaattggtatacggtgaaatacaagactccctgtctctactgtctctccgttctccacttccgcagttcttatcctctacaatattctcatgctttaagagctcagtggaacagagtatttgaaatgaacgctttcctgaaacatgcctgggatgtgtgatttctgaaggtatattctcattggtattccgagacagatattcccactgtgtgattgttttaaggctggttactctactgtctttgctaaactcataaacttccaactgtctcacttatggcctaaattactacccctgccatgattccaatactttttttggcagaaaattttcatttatgacaagatccccaatgactaggggtaaaataaaatgagaaacatcaagtgagaaaaagaataccttacttactttattatccttgtgattttacatcaatgactctcaatcctgactatactctctagtaacctagaagggtttagaaagaattccagacaacgtactctagacaagtcctaccctagcctagacaagtgaatttgaatgtattagggtggggctacggagctgtacttttgggtgtgatattctatacatgtatattaaaaacttaaaaatctatgagtgattaaaaaatttttagttatttgtaaagttaagaataatgctgattatttttttctgccacttgacaggtgtggttgtatgattttcatagtttatcccttctattccttgctttttaaaaaagttttagggaagtttaatttacacactgtagcatttacttatttgaagtgtataatttaatgatttttagtacattggcagagttgtacaaccatcatcagggtccaattttagaacgctgctaccacctcagaaggatccctgtacccatttgcagtcacatcctgttgctaccccagccccaggcaaccgctgatccactcttcatccctgtagacttcaaacagctatatttttaaaagcactgcagctaattcagatgctcagtaaaggttgagatctattcccttggattttccagcagaccttaggaatattaactatatcaaaatcttgacctacagaagcagattttaaattaaacaagattgggccaggtgcagtggttcatgcctgtaatcccagtattttggaagggcaaggtcggtggatcacttgaggtcaggagttcaagaccagcctggccaacatggtgaaaccccatttctactaaaaaaaaaaaaaaaaatacaaaaattagctaggcgtggtggcccatgcctgtaatcccaggtacttgggaggctgaggcaggagaattgcttgaacccgggaggcggaggctgcagcgagctgagattttgccattgcactccagcctgggtgacagagtcagatttggtttaaaaaaaaaaaaaaaattaaacaaagttgtttctcaatttcatggggcccttcagattactctgactttagatccttgttaaaatgtattttgttcctcttttccaccgacaagttttcactctcagatacaggccagtgtagaattatgtggttggtggaaacaacctcttcccatctcctgcttctgctcttccacatggagaccagagatggagaaatcccaatagccaagctcagtgggccggtgcagtcttcgtaatacagtcttaagctcgttaaattaggtatctcatcttcttttggagaaaagcatgattgttcaggacatttggtgtcaaaaaagagcttcttaaaggtacttgagtccctctctggcttcttggacttgtgggacttgcccttcccacagtcctcctgctccaaccccaactccacgttgagagaagaggctccaagtctggcttagcgtcagccttcatccctgtggtttgacggctccattgccaacctcagtggttcccaaactttgccgcccgttagaatccacgggagcttttataaatctattgcttaagcctcacccatgccaatgaaatcaaatagctgccgatggaaactaagtgtcagtattttttattaagaagatccccttgtgattgcaacggacaataaagtttggggtctagactgtgatgtcctgttttctagcaatattccgctgtagttcccgccactttgttttctaaactcttttttttttttcctgggctgcttgaccccatttccaagctgccacctggggttcctgggtaacctcaattcctcatctctatcaaaactgaaggacttacaagaccttgcgctaacctaacattaaaaggaaatcttaactctaggaatggggagacctttgtaactgttttcatgttctcctgccatctggttcatcaccgagaagtgtttggccgttaagaacacgaaagaaagagatagagtatcaggttatgctcttaaaaaaatacattctaaaaagacaacctacagaataggagaaaatatttgcaaatcatatatttgataggagtctagtgtccagaatatacaaagaatccttacaactcaaccacaaaaggataaacaacccaattaaaatacgagcaaaggacttgaacagacgtccttccaaagaagacatatgaatggccaaaaagcatcagaaaaggtgctcaacacaattagtcattaggaaaatgcaaaccaaaaccacttctcacaccctaggatggctataatggaacaaacaaaggaaagttacaagccttggggaagatgtggaaaaattaggaccctcgtacattgctggtaggaatgtaaaatgaagcaggaaaatatttgaagattccttaaaaagttaaaacgagcaagttaagagatctagcaagacccaagatctggcaaaatttaccaatgtaagtcaagaaaatgctgaaaacctaatatcactgtcataaccaacagttatttctccctcagttccttcaacaaacacttacagagcacctatgctaggtatatagtaaattgtacacttaaaatgagtaaatcttatggtgtgtaaattaaacttccataaaactttttttaaaaagcaaggactagaaagagtaaaccatgaaagtcatacgactacacctgttgagtggcagaaaaaatagtcagcattattcttaactttacaaataactaaaatttttaaattacttatagacgtttaagtttttaatatacatgtatagaatatcacacccaaaagtacagctccgtagcccccccaatacattcaaattcacttgtctagggtaggacttgtctagagtgggttgtctggaattctttctaaacccttctaggttactagagagtatagtcaggattgagagtcattgatgtaaagatggagcacatcctctgggtatatattcaaaataactgaaagcaggtacttaaatacttgttcagaaatgtctacagtagcagtattcacagtagccccaaagtggaaacaacaaaaatgctcctgaacaggtgaatggaaaaacaaaatgtggtatatgcgtacaatggaatattatccaggcatgaaaaggaatgaaacacagatacatgccacaacacagacacacgctgcaacatggatacacgctacaacatggacacatgcgaaaacacagatacatatgataacatggatgcatgccacaacacggacacacgctgcaacacggacacacgctgcaacatggacacacgctacaacatggacacatgcgaaaacacagatacatatgataacatggatgcatgccacaacacggacacacgctacaacatggacacactctacaacatggacacacgctacaacatggacacacgctacaacagggacacacgctacaacatgggcacacgctacaacatgggcacacgctacaacatggacacacgctacaacagggacacacgctacaacatggacacacgctacaacatggacacacgctacaacatgggcacacgctacaacagggacacacgctacaacagggacacatgtgaaaacacagatacatatgataacatggatgcatgccacaacacggacacatgctacaacacggacacactctacaacatggacacacactacaacatggatacacgctacaacatgggcacacgctacaacatggacacacgctacaacagggacacatgtgaaaacacagatacatatgataacatggatgcatgccacaacacggacacatgctacaacacggacacacgctacaacatggacacatgtgaaaacacagatacatatgataacatggatgcatgccacaacacggacacacgctacaacacggacacacgctacaacagggacacacgctacaacagggacacacgctacaacatggacacatgcaaaaacacagatacatatgataacatggacacacgctacaacatggacacacgctgcaacatggacacacgctgcaacatggacacacgctacaacatggacacacgctgcaacatggacacacgctacaacatggacacatgtgacaacccagacaacatggacacatggtacaacatggacacatcccataacatggatgcatgtgataacacagatacatgctacagcatggacacatgtcacaacacgaatacatggtatcacatggacacatgccacaatgcacatacatgctacaacatggatacacactataacacagacacatgccgcagcacggatacaggccacaacacggacacatgctacagtgtgacggagtctcgaaaacattatgctaagtgaaagaagccagactgaaaaggtcacatgtgtatgattccatttagctgaaatgtccagaacacacaaatccgtagagacagaaagcagattggtagttgcctggggctgggaggagggagaaatggaaagtggctgctggatggttacagagtttccttggggtgatgaagatgttttggaacttaatagaggtagtgtttgcacaacattgtggatgtactaaatgctatttgtttgtatacctaaaaatggttaattttggctgggcatggtggctcaggtctgtaatcccagcactttagaaggccaaggtgggtggataacttgaggccaggagtttgagactggcctggccaacatggcgaaaccccatctctactaaaatacaaaaacgagctgggcttggtggcaggcgcctgtaatcccagctacttgggaggctgaggcaggagaatcgcttgaatgtgggaggcggaggttgcattgagctgagattgcaccactgcactccagcctgggagacagagcagcaagactctgtctcaaaaaaaaaaaaaaaaaaaaaaaaaaaaaggttaatttcatgttctgtgagattcaccttgacttttgttaaaaatgaaaaaattacattctaggtggttagaatctcccttcctccacatgccctggaagccagtttgctgtgttctctggctgttctctgtgggtgcttcacatgtgtgggaaggcaaataaaaggactgggtactaaccaatttatggcttgctttttaatcatatcactcctgtgtaagtgtccaataaaatgccaatcttcaaataatcctaagaactgaggaagcgtcattggaaagaagagaaccactgaaaatacagctttatgaccttttatttggaagacctggtggctgacactgcagctgtctttgaggacaggctactgaccagccacacatcccgcaaggtcaagtcccctcgaccagagactagcacagtgtcctgcatttcagttgatgcccaagaagggcttgaattgaacctgtttaattttttttttttttttttttactttatcttcttattttcttttttttcttttactttaagttctgggatccatgtgcagaacgtgcaggtttgttacataggtatacatgtgccatggtggtttgctgcacccatcaacccgtcatctaggttttaagccccgcatgtattagcttttgtcctaatgctttccctccccttgcccaccaccccgtttttgaaattattctgatgtttttctttgctctgtgagcatcatgatctgcctttgctgtgaagacttcggttgtcttcgtagacacttggtgtggcacctggcatagaatgggtgctcagcaggtgtttgttgaaggaactgaggggaaataattgttggttatgacagtgctatcaggttttcagcactttcttggcttacgttggtaaattttgccagatcttgggtctagcacttatgttgttatgaagcagggattaagagacaaaagtaataactaactttggttccagaaaattctggttacagaaaatctggataaatcccccttagctagggttgccagatgagatataagatgcccagtttcatttgaattcagagaaacgatatgtcctgtgcaatatttaggacatgcttgcactaggaaattattcattgtttatccgaaattcaaacgtaaccaggcattctgtattgtaatttgctaaatcgggcaactctgcctattaaagggctgcactgtgactggctgtgaaacccccagctccagggtcccggtctgggtccggtctctgctctgcggctggaagggcaggaccctgtttggcctctgcgaaatctctgtacctttgccaggaaacaatctggttgttatgtgaaggtttccagcattgttcacacagaaattattcaggtatgaatcatttggccccatagttggttgtgttttgatttttaatccaatatgaaaatccatgttatcttgtttgttttgacgttggctgtggctcggtcaacccaagagcgtggcacggtcaacccaagagtgtggcacagaggctttggcttttctctgtagcccaataccggtgagacacctcctctttactgtgaggcttcactctttttcttcctttttcctgctgccttggcttgctgtgggaggtggatgttgtcagcatgtatgacctgggccatcgcagctgtggctgaaccagaggtgggccgggggatgtgatgcagatcaccaagagcatctgccacaccccctgaacactttcgggaagagaaacatcagttcccttgaagggctgctctgtccatctgcccagctatgcactaatgcatttcatcattttcatcctcagtgttccgcaagctggacgtgaactctcacatgtttctggcgctgtgcaaggttcctggaatctacagacgtctaagatgttgtcactgcctttgcagaacttagagctggcaattaaaaaccttgtaaaaattgtgataaaaagcacacaatgtaaaatttaccatcttagccatttctttttctttttctttctttctttctttcttttttttttttgagacagaatatcactctgttacccaggcaagagtgcagtggtgcagtcttggctcatggcaatctctgcctcctgggttcaagcaattctcctgcctcagcctccccagtagctggggttacaagctcacgccaccaggcccggctaatttttgtgtttttaatagagacaggttttcaccatgttggccaggccgatctcgaactcctgacatcaagtgatctacctgccttggcctcccaaagtgctgggattacaggtgtgatccacatgcccggcccatctgagtcacttctaagtgtttggcagtgttaagtctattcacattggtgtattaccaatctcctgaacttttccatctcccaaactgaaactttgtacccattaaacactgactcctcatctctccttccccctggtcccagataaccactgttctcctttctgtctcatctatgaactggacaactttgcatacctcatgtaagtagacttatacagtatctgttcttttgtgtctggcttatttcacctgacataatgtcctcaaagtttatccatgttgtaccacatgtcaacatttctcttcttttgaaggctgaattatattgcactgtgtgtctgcaccaagtgccactctgcttttctcggttattagcccctgctctgcctgcgtgccagagaaccctgcaaaggcatttgacagaagtctctcaatctcatattccttggctgctctaccattgtttctggtgggcttccatttggttgaattcaaatgcttggggcagctagtatttgaggtctccaatggacacgtgatggcagaaagggataatgcatatatatatatatatatgtatgtatatatatacacatatatatacatacatatatacatatatacacatatatatgtgtatatacatgtatatacacatatatatgtgtatatatatatatatttttttttttttttaggcagagtctcactctatcgcccaggttggagtgcagtgacacaatcttggctcactgcaacctctgcctcccaggttcaagcaattcttctgcctcagcctccttagtagctcatttttgtatttttagtagagacagggtttcaccatgttagctaggctggtctggaactcctggccccaggtgatctgccccccttggcctcccaaagtgctgggattataggcatgagccaccgtgcctggcctgataatgcatgtttgtttgtttgttttgagatggagtttcgctcttgttgcccaggctggagtgcaatggtacgatcttggctcactgcaacctctgcctcccgggtccaagtgattctcctgcctcagcctcccgagtatctaggattacaggcatgcgccaccatgtcccgctaagtttgtatttttagtagagacggggtttctccatgttggtcaggctggtctcgacctccccacctcaggtgatctgcctacctcggcctcccaaagtgctgggattacaggcatgagccactgtgcctggcctgggaatgcatatttttaagggttaacttttagaaagtgtgcttgctgggtgaggtagttgtacttgttttcacacatagtctctcttgggaaattttttcaaatatggaaaactgagagttgggaatctattattttaggaaggaagagcattgaataagcagtgaagaaagctgatttgctaagaaacctgggcaaacatctacttaactataaaatactacagttgagtttgaatcccttcagctataaatttgaattagtattctgtgctatgtgttgctatcatatctatatgatgctgttttccaaaaggatttaaaataccaaacattcacgtagggggaagaaaaatcctttcccaaaggaaaactgtggatagtaagagacttatgaaggtattttttttttttttttttttttgagatggagtcttactctgtcgcccaggctggagtgcagtggtgcaatctcggctcactgtgagctccacctcctgggttcacgccattctcctgcctcaccctcctgagtagctgggactacaggcgcctgccaccacgcctggctatttttttgtatttttagtagagacggggtttcaccgtgttatccaggatggtctcgatctcctgaccttgtgatccgcctgccttggcctcccaaagtgctgggattacaggcgtgagccaccacgcccggccttatgaaggtatttaaccaaattccttctcatcgtcattgcctctgtgttaccagtttttctttcaatcctctgctgatttgcttgagttttatctttattgccaccctcagagggtagtgctccaattattcacagtatttttgacctccatatatttaagaaattgcctcgttggatcccaggtaagcagggttcataaacaaacatagacaatttaagcttctttctaaagaggaaatgagcaggcagcgtgtgttgggaaatccttttgtcaatgcaccaggtgttggctgcttttctccgacagcagccaaaacccagaccctcaggaaacagaggccaggaaatccctctccctatcaacccagagggtggcgcttccagcccgtggctgtgagcatggggctcttctcaatcttttcacctttggcattttacatagcagttggctgccatctttccccatgtgataattgtctaggaaaagattgtatgtttgcgaccaacctccatgtatcaggacatcactaaggacatatgttttgttctcttcaactctgatgcacaagctataaagtactttgtcattacctaataggatcagacataggaatatttaatggcacttataaacatggttcttaactttctttagagtccttggagaatgtggcaaaatcaatgcatcctttcttcagaaaaaaatgtacatttacgcttacgtgcaaaattctgtgtataattttaagggactttcagacagctactgacttcattatattttgtaaagattattctttttttaaagattattctttatataagcatattgacatatgtataatgtgtatatatattgaatttcctgttatgaatgtttattatgtgtctgtccttttaaaatattgtttttttcaagctttcagtggtatagagaaaactgttatgacaaaatgtgaactgtatgttatccaagagcatttttttctttataagttgcctttcataatggacaaagtacaaaaaactacttctgaaggggaagaggatggagctagtatgtattgagcacctactgtctgccaggcaccacacggggtaccttacatatgagatctcactacatctcaacaatgattctgtgactgtggaattgtttccatgtaacagatgtgggactgaagctcaggaatattaagtcagtcgttttgattcagtcacactctagaacccactctctttggtattctgtagtttgcaaagataacacaaaacttcttgctctaaaatactgggctttagaaaagaagagagccccctgggagtcctggtggcctgagaggcagggaagagtcagtgagtggaggaagagcatgaatgaattttcccgagggcaggagaggcagttgtgtgtccctggggttgtcttgcatgggatcaccaatgcctgcatgaagacaggaagatgggattagaagacttggcctccctcaaatcggagcagctgctccagctcaccatagaagtgggcaagaaggagagaacacgaaggaggaaagagacatgggttctcattagacaagtgggtcagattcttcctcttttttgttctgcaccaatgtctttccttgcggtcttcattaacctgtgactctgatgaccctgcgggtgacactcatttttgtgcttaggaaatatctgtggcggtaagcagggtgagcccccattcacagcaaggaaaaacggagtcatgttcttctgctctgggattttggtcagtaacggtggaacagcccatatgaacctacttaacagatttttttcccccttaataaaaagatgattctattttctagagatgctcctctggaattgctcccagtaaacttaaaaaaaaagtagtgaaaaatttattgggtcacatttactgtctgcttcttcctgggtggtggttggcctcaggaaccaggctccttggtgagtaaccaaactgagaatcaacccattctttgggtgtgtaaaataatcccatttagttgaatctcatgaattttcatcatgagctagtaaaaccagaggtcactaggaagccaaaataatcatacagtatccttcctcatggtccatatcaaagagcctagtcgagtgaatgatggacagagaaattatactttctaatccccagtgcttttactcagccatgaatggtattaattcagggagcttgtaaaaagcattttcacgagattggaagcaagactaagtaggtacatgctggcagcataaagagagtctaatctaattattgtagaatcttagagataatctaagtgctgcctaattgcatacaacacattttattgacacttttctatgtgtaaggcacacagaccatgtgtaagctacatgcctattttctatgggcaaaaaccggaatcacccagagggctcgttaaaacacaaatggcggagtcccatccccagagtttctgactccgagtttctggggtgggcctgagaattggcatttctagcaagttcccaggagctgctgatgctgctggttcaagatcacactgtgagaactgctctacaccctcgtgggggggattattccagggttcacttgagcccttctaatgggatgggttgtgaaggcggccgatcccaacaggacagctttcttagggttcaccgacactgcgctgaaaagtgcctcccggaaactctctccctggtcctaattctgccggctggaattgctctggacacacctaatcctcatttaataaatgcccatgcacattcatcctaaggagaaggacagagaggggtctgtttggcaaataacattgttatgttccatgccggggaatgcctgtttaatctactttgctaacaataaatttaaatgttaataactggggtgtacatacaccataaacggtacaaatgtcatgtgtacagcttgataaaattttacataggtataccctcattcaactgccttccacctcaagacatggaatattttcacccttcctcaaaattaccacgtgctctttcctggtcctgagcaggccttcaaaggtcagcagtgttctactccagttgccatgggtatttcatgctcctcttgaactttatgcagatggaagcagagagaacatgcgcttttgtatctgatattttcactcaagaagactgtgaggttcaaccatgttctaaatagcaatattagttcttttgtttttattgccttgtggtatcccaagtttgacttgtgtttatagttgtatatgtaattgctccttctatttttttttttgcgggggtagggggtggtgggatggaattttgctcttgttgcccaggctggagtccaatggcactatctcagctcactgcaacctccgcctccctggttcaagcgatattctcctgcctcagcctcctgagtagctgggattacagccaccacacccacctaattttttgtatttttagtagagacgaggtttctccatgttggccaggctgatctcaaactcctgacctcaggtgatccacccgcctcagcctcccaaagtgctgggattacaggcgtgagccaccgggcctggcccctccttctattttatatagttaaggttggaaattgatatggtttggctctgtgtccccacggaaatagcatttcgaattgtaatccccatgtgtcggaggagtggcctggtgggaggtgattggaccatggaggtgaatttcccccttgctgttctcgtgatagtgagtgagttctcacgagatctcatggtttaaaagtccggcgcttcccagttctgtctctcgctcctgccgccttgtagacgtgttcgctttgcgtttgccttctgcgtgattgtaagtttcccgaggcttccccagccatgcggaactgtgagtcaattaaacctcttttctgtataaactacccagtctcaggtacttcttgataacagtgtgaaaatggactgatacagtaatgatataagctagcatgactgctgactgtgaactggaaaatggtgctaagtacgtgacatcacttgatcttttcaatactgtgagattggtactatcattaatccattttacagatgagataaccaaggccgagtaacttgctcaaagtctcacagctgttaagaagtgaaaccaatatttgaatgcaggtttctgaccatgatcgtgcgttcttagctgatatattatgatgcctgtcactctgggtgctttaacaatgaccaccaatgagagattgaccctggacagcatgcagtttcctttaatttcaaggacttttcctttttcagcacccgtttctttgtcctgtctaatgggtctaaggcatcttcaaccatgctggtagtgacctgggctgtgccacctgtccatgcactgtctggattttcccaactccttcagatgagcagatctgtggactcgtgttctctcttatgtaactgtctccctacaaaaataaccttttctctttgctggctctctgatcacttccaaaatccctgtccttgataagtgcaaataatagaagaatctgttctaccttgtggttcctgttaaggttacacctaaattgtctctgaaaaataattgcctattttgttaaaggaaatgtttaaacttcctttgacttgtgtgtctaataaaccctcagcagaaggaagtttatttttaaatacaaattactgtggccacttaacgcctcatttcctttttcattctgctaattggagatgggaaatggctggtcagcctatttcatgctatcaacttgagtacatttaaaaagataatcagaggctttgcagcagttttaagtctggctttgattcaatatctggataaaaagcctccacatgcccttatgattaagaattcttgtttatgttttcatgttctccagggtgcatgcagacctcatcttttggggttttattgctaagtacatagatatggtgttgtttgggtttataaacgtgagtagtttgctaaataattctctgtgttctaacaggaaatgaaggtcaggactaaaagatgggatgctctttgcttaatctgtcatcacactaggttttcataaattacataatatccatttatctgtttatctttctgtaattctaatttatatcctaaatttcatgtgaaaaagctttgagaatttttttttttttaatgagccgtaagccgggcatggtggctcacgcctgtactcctagaactttgggagtccgaggcaggaggatggcttgagcctaggagttcaagaccagtctgagcaacatagcaagaccctgtctctacaaaaaacaacaacaaaaaatgatccaggtatgctggtgtgtgcctgtagtcccagctacttggcaggctgaggtgagagaatcacttgagtccaaaagtgagctgtgattgcaccattgcgctctgggtgacagattgagacgctgtctcaaaaaaaaaaaggaatacagaaaaagagaaatcccataggacaaatgaccagcgatttatcacatatatgcagcatcacaaaagaggtggaggcagacactggagattaaaagaagcaagaaataaaaatggaatgtgattggggactcttctaatcttcattcaagcaaatcaaccataccaagaccctttctttagggaatcagataaatttaaatacaaactgagaattagataataatagggcattgagcattaattttgttacttgtgataatggttttgtggttatgttagtaaaagagttcttacaggtaaagacatactggagtatttatggatgaaatatggtgtctggaatttgttttaaaatgctctaggaaaaaatggggaatagataaaaacatacaaaaggttggtaacatgctgatgtttgttaaagttgggtgatgggtacaggggttcattttactattctctctacttttgtgtgttttaaaaatgttcataagaaaaggttcaaaaagaggcataagaggaaactatatgatgacataactctcgcattgtgatatatgagtacagtcttagaagttcctgtgaaatacaagcctgtaataaaatgaaatctaaaactctgtgtctgccaaacagtttttatttctttttggaaaaatatatattaagttattaattatgtttctatcttgtttgcagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggtaataggatcgtcgttgctatttcatgttggttggttggtactttggacagactcatactgtggatcccaatatttacctaagggagagagaactttctgcttcttagtaaatttgttttaatccaaagtatttcttcaaagagactagcggtatttttttgctgagggaacctatttccagcttcagtaatctgcagcgcaagtgaaatctgtaatataaagctccctgtggtgttttagatgaaattagaattttagttcatgctccattttattttatttttgagaccaaatctcactctgtcacccaggctggagtgcagtggccgatctcggctcactgcaaccttcgtctcccaggttcaagcaattctcctgcctcagcctcccgagtagctgagattacaggcacccaccaccacgccccactaatttttgtatttttagtagagatggggttttgccatggtggtcagcctggtctcgaactcctgacctcaggtgatctgaccccctcagcctcccaaagcactgggattaccggcctgagccaccgcgcttggtccatgttccattttaattaaaagaggctgctcatttccctttaggtcttattgttccagagacagggtggggatattaaaacctattaattgcatccagaatgtagagaatcttgatgtctcaacttgtaagatgcttggtaaaaaaaacataatgaaggaagcagaattctcaagtagcaaaagtccaagggatggataattaaacttgaactggtagtcatcactgatcaattttaaagggaagagtctacccttatacagattaaatgagcaattagttctcttggagggatcagggccttagataattttactccgggtgtggaatctcaccctaaactctttgtcatgctttaacttttagaaattccatagactacccacttcaggtatttttgctccccgctctaggtactaccgtttttactttcttttccctccaccaggttctaaatggctattttgtgcactactttgctcctaaagaccttcctcctttacccaagaatgtggtattcgtgcttgacagcagtgcttctatggtgggaaccaaactccggcaggtgagtgagtgccaaccgcccatttattcctctctcgcttttgcctgggacaatgacttgctttgcgaataaagttcggtagatgccaaacgtcagctttaccatccagcgattcctgcctatggaaagccttcttgagcggattcagttaagtcatttgacataaactgtatttcagcgtggtggttttaagagagcagagggacgtgctgtagaaaccccttgaaataaacagcactggcagagtggataatgtaagtgagacaggaatccatcgacagggccagtcctcagcactatcattgatggagtaattctgttcagcgatgattcctttgagaacagtggaatagaatcattggaagcctccttagaataaagaactcaggtcacagtaagtcaggactgatgtcacaaaatttaggatgaatcttaaaattccagggtggtggggagacattcaggggtcacgtagtttatgtcgaaaaattagattcctgaaaatatgactatttatgcttttcttacaaaccactggaaaagactttcttatcttattctgctatcataaatgtcagaatctttcatatacgatacatttcaaactcacataatagaaaacagagctactggctgccagaccagctaatatctttacattcttcaaaaacatgaatctgttagtttgtcttctaaaattcattatctattttattttatttatttttttgagatggagttttgctcttgttgcccaggctggagtgcaatggcgtgatctcagctcactgcatgcaacctctgccttctgggttcaagagattctcctgcctcagcctcctgagtagctgggattacaggcatactccaccacacctggctaatttttgtatttttagtagagacagggtttcatcatgttggccaggctggtctggaactcctgaccttaggtatccacctgtctcggcctcccaaagtgctgggattacagacatcagccaccatgcccggcctttttcatttttttatacaattcacaatgcatttgtgatttaatgagtgagatactatctcaaatctcatagaaactctctgtccaacctgcgtccacctccaggtcctgcctcacacgcagttgaacctactcctagctgataaactgttgcaactattttttctcaatctcaatctactactttataaatggcttctttggccatttatattttaaaaatctggcagtgaaatctgtatcttcatggctttcatggttttccatggctttctggtttttcatggcatctggttttcctacactccaatagagcaaaaacatatttcaaaatatgaagtgagactagggtttaactattgtctttcagagccggggtatccagtcttttggcttccctgggccacactggtagaagaagaattgtcttgagccatgcataaaatacactcacactaacaatactaatgagctaaaaaaaaaatcacgcaaaaaaatctcacgatgttttaagaaagtttatgaaattgtgttgggctgcattcaaagctgacctgagctgcatgtggcctgtgggccaggggttggacaagcttgttttagaggatagccaaatataatgtcgaactaatgtagggggaaaataaccttgctctgtgaatcagcttttagtggttctttaacatcacgtgctcgtccagagcgcaacctgccaactgctccatttttgactttttcttccttctgctttcttgactttccatctgggttccttttcttttgcatgaggaacatcatccatgagcgtatttttaaaaataattctctgtctttgtctgaaaatgatttattttacttttatcctttaaggatagtttttactaggtatggtattctacactggcagtcatcgaatgatgaacataatatttgaaaatctgtttgtagaaatagtttgaggcctaagataatggtctgttcctctagagaaggtttgggcttgtttctgtcagatctctgggggaataaaaatctgggattactttagtccattttcagggatggaggtgtttgggcagcccaaatggcacgaagctggactgcagaactcttaggagctggcatatttctgctttgcacacagtgtagatttgccagagcacccctaagctacagaggggatgtgcggcctctcaggtgtctcttcggtcttgacaaacatccttgagacacaagtggtcccaaatgctgagctcacctcttaaaatttgcatcttctctcagattttttttctcactgttttgtttgctttctgctactttaaagatttttttaaaaccccatttgtttagcttttttagttcttactgggaagctaaagaaaatatttaagttctttttcaaatctcctctgtgatgttttaggattttccgttttttacagtttttaatcttttatattttctcaagcacagtaaacatgtacttgtctgtgtctgcgaaatccaaactttggagtcccttagggctcaagttacttgtaggtttcccaaagtttttcccaaagtttttgttacaccaaagtgaagctttctcttatagtggctgatatttattgatgttttagaggccacatagcctttccttatttaccaaataccttgtgaagttcttcgcattatgggctacaagttctttttttttttttttttttttttttgagacgaagtctcactctgtcacctgggctggagtgcaatggcatgatctcggctcactgcagcctctgcctcctgggttcaagcaactctcctgcctcagttcccccaagtagctgagattacaggtgctcgccaccatgcccagctaatttttgtatttttagtagaggtgggatttcaccatgttggccaggctggtctcgaactcctaacctcaggtaatctgcccacctcagctttccaaagtgctgggattacaggcatgagccaccgcgcccggccctgtgtactacaagttcttaaatgccattcgttgaccaagttgttttgtgacattgatggctgcatgatcgatgctgacagaagaataaccatggcttcttttaagaccactgtggatcacagaataccgtgttaattaggcttacatacgatcagtatgataattgccatttggattttgaatcacttaacagttactgagagggtaccatgggctgggtttcctcaggcatctcatttaattcctaggtacctatgaatcttcagatgttctttcttttcctttctaaaaaaaaaaaaaaaacacagcttttttgtgggggcagggtttgtatttcctctgaacaaacataacttgctgaagatatttatgattaaattaactgcaaccagtctgaattcctgtgactaccgaatagtttgtcttctgatgtttttattcacccccatattatgaatatatcttatggcattaaatattctttaaaaacctgattctaatggccatagagcaacactgttcactagaagcttctatgagaatgggaatgttctacacctgtgctgtccaatacaatagccactagtcacatatgggtgttgagcaagtgaagtatggctaatggaagtgaggaactgaatttttaattttaataaatttaaatttgcatagttaatatatggctaatagtaaccatatgggagcgtgtagctgcagaacatttattcaccctaccacccattagagacttttcagccatttccattttttgtgataataaaccccatcgggatgactgtcttcatgtagaaatgcctgacgcatgccctgtcattttcttaaattagattcttagaattggaattactggggcaaagagtaccaattcatttgtgggtttggtacacattccaaaaacattttctaaaaagtctgtgccaatttataacatttaaaactgttactaggctaagatttccaaatgggttaagaggcttaaggtaatcaatgaaccacaccccaaaatatgtaaaaaaaaaaaaaaaaattgcaggtggatatttaactgattttcaagtgggaagaaactttctaagcctaaaagcagtataatcacttttaagcctaaaagtaattacaaaggggaaaatcggtaactttagctacataaaaattttaaatttttgttgtaaacaaaaaaaagtaaacaaaacactagaaaattgcatgcaggaaaaagaagtaagtgtatcattaatatgtaaagaactgttccagattaatgaaaattaatcctatataagaaaatgagcaaaggatataaaacaagctactagaaagaaataagatgatttgataaaattatgaaaaaaccatcaagcatattagtaattaaagaaatgcatctcaggtgccagagcacttcagggtttaacctcaaacctagtccaatccagtgccccagggttgtcttccacttcctgtgggagaatgatcaagaatcttcttgccaaataaccctcagaaaaataaaccctgccccaaattatccagagaaaaactaatgaactaaattagggtctcctaaatgtacctttaatcataaaataattcgggcacttcttaaaaatatggcatgggccatttccaaaatagctaagagtattatgtgaatgatttaatgcaagaatctttaatctttaaaataatttagttgtcatccccattttactgatggagaaactgaggctttgcaaaggtagataagttggctaataaatggtggtggcagcctttactcccaggtctgaagtctgagaactaagccatgtaccgtgcaagtaagagtgtggttgcggcaagaaggcacacatgtatgcagctggcagaagtgcaaatggatacaaggtcaaggcagtcttacatttgaagacccaactgagaaggctgcattgcagaaggcagggatttcctcgcatgatgcaagagcaatgtaataacagatgtcagatcatttgttattctcccctcttccttcattcctggatattaaaattccattccttgctagccactgaaagtctggcatgcactctgctggcttcgaagcttcagcatggcctctttccaggagagccaccctagaccagccaaacacatgtctgagcaattttgaaagcccctcgctgccttgagtggttttgaaatctgcggactatttttgcagttctcagcatctccaaggccacagtactaagtgaaaagcttagctggctctttgaagagtcttgtatatgatgttatgtctattggtgaagaggacaattatcccaagcaaagggcttttcatattgtgtcaacaggcttggcaatgtgggacatttgtcatgcatccacatggattctattaagaatcattcactgttattcccaatgttcttggctcccctcgtctttgacgggcctgaaagaccttgctgcatttattgcaatgtaggacacatagttggcatttaataattacttgaactattgatttagaaaaagctgtaaagaccattcaaccttaaaaaaatattctcggtaaggggtatattggcacctggggagcccccaaagctgtgtgcctctggcattttctggttcttgtcctaatcccagtgggaacatgatcctggaagccaggacctgcctggcttgggaacagcaacagagctgcctgaggtttgctggcacgtggctttgctgttttccctcccgtgtgcttttgcagatgagtttgttgagagatggctgtggtgttgggtcaggcagggtttctacctcccagtttgagctaaaacttcttggtgagaatgggagctgagaagagccaaaaaaaaaaaaaaaaaagaaaaaagaaaaaaaagaaagggaggggggagaaaaatgtaatcagggaaggcttcttttttttgttgttagttgcatgcttaaagcattgacatttgcagacagacatgtagtccttgggaggattaagaatatgcttttccttgaccatggtgtccactttcttgtctttcctttccctgatctatagaattagatctactactttcacattcatattaaagaacttggctaagggaccctctttggcaaccaagcagtgacgaatggatcacttaccagatgttttccatgctttaatggtcttcaaacctgttcccacactctgtgtccctctgtgccaattctgggttcccacgtagcctttgaagcttgtcttcctttctccattttatttagttgacaaatttagagggtaaagaacaagcatgtttcttatctgtaattgtcaagttaaaatgagggcaaacgtgaattagtcaagttaaaatgagggcaaacgtgaattaacgagtaggaggactgggatctgcatgtcgattttggttcactcacaggcttactttatgctctaggacattggtttctccctcgctgtccaaaattgggttcccaagggctatttggatatttcatgtgtaaccttacaggtgagtaatttgtaagctccatggacttggggaacatcttgtgtttgatcattacaatatgcattcccaactcttcacagacagtgggtaatgacatttgctgccaaactaccagcccacaaacaataaatgtatcctgcatttttctgaggcacagtagttaccattgagtgatcagtgcgtatcaagtgctgtgagggttttacgtacatttcttcatttaatctttcagccatccagtgaagtaaacattgctctccctattttatgcatgggaaggtggagaccaggaaaatgatgtaattatgctgaaatacacaaagttataagtaggaaagttaggattcaagcccaggtcagccttacctaaaccacttctctgtaacgtcacatatggaccgtaacacagtggtggtctgtagaccacttttcaagctttgaggctctgtttttgtcaccaagtaacgtgaaggacagtgcactcaggtgagtgcacacagatgtcacctactcaaagaggtgccagccagcaggctagtattgtgaaaaactcacgaagctgttctgctttgattcgtagaattattgagcaacgttttattatttaacactaagcactccttgggcgtgtatggggaggcaaacttctttccctttcatgatgtggatcgggcaagtgacatccgagtgtgcgtgcagatggcagaaatgtagactgaggcaaagtggctcgggcaagctgggtgactgtcaagtccagtgatgtccaacagtgtgatattgtagctgccttcttcagactatgtgggtctgccacatttcaaaagagaggatccaggccaggtatggtggctcatgcctgtaatcccagcactttgagaggccgaggtgggaggatggcttgagcccaggagttcgagacgaggctgggcagcatagtgagacctcatctgtaccaaaaagataaacaaaattagccaggcatgatggcccacatctgtagtcccagctacttaggaggctgaggtaggaggatggcttgagcccaggaggtcgagactgcagtgagctatgatggcgccattgcactccagcctgggcaacagagccagaccttgtcacaaacaaacaaacaaaaattaaacgacggagatcaaagaaggcagtcagattcaccgagcagcctggaggaaagctcagcatgagctgcgggacccagagggcctctgagggcttgccatctggttaggggagagaaatccctgaacaaatgaaggcgctcagaaagcaggaggatgcaagcttgcccagtgagtgcatgcctgaaagactgggggaaggggtctcagaaggcaagcgctatgtggctatcatgcaaataaaaatcgacaacagagagcgtcgggtccacctgctttgcctgttcaggtctaggccttgtttaagcacctgaaagcaaggccccaggaaatatcagaaggaaatatcagaagagtctagcttccctttttggctttctggagccagtgtcatcaaacttgtttgtaaaggggcagatgataaacatcttaagttttgcagacaagattttttttttcttctttcgagactgagcttcgctcttgttgcacaggccggagtgcaatggcgctatctcagctcactgcaacctccgcctcctgggttcaagcaattctcctgcctcagccttccgagtaggctgggattacaggcatgcgccgccacacctggctaattttgtatttttagtagagatggggtttcactatgttggccaggctgatctcgaactcctgacctcaggtgatccacctgcctcagcctcccagagtgctgggattacaggcatgaaccacagcgccaggctgaagattcatttttccaagtttctcccctctcccctcctctttctttctgtagagacagggtctcactatgttacctatgctagttttgaactcctggactcaagcgatcctcccaccttggcttccaaagtgttgggattacaggaatgagccaccacgcccggcccccagatggtttctgttgtaaccactcaactctgctgttggatgcaagatctgtcctccttgtgacaagagcacagccacaggccatatgcaaagaaatgggtgtgattgtgttccagtaaaagcttatttactaaaagcaggcagcagcagggcccctgagccacagtttgctgacacctgtctagagcaaggactcatcaaaatgaccttgagttacatgccagttgattgtgtttattctcgtctactgggctgcccttgtcaagacgttgctaccagcagatgcatgtttcaggaaaacattgcaaaacagagatttgagacttgaggcaggaagcagaagacagtggggaaaactggtttttgtctctgactcagaatatgaggtaataaatgatggacagagggcaaaatattttttccctaggccatgagtgaaagcttgaatttttagtttcaagaaaaaaaattgctctccaacaatgataatacagataatttaaaataaattagaggcacccattgaaaaatttattgctgttgttgaggtagttaagatttacccggatgaagtatatcttagaggtaaaatgaggtcctattttatttatttttcctttaaacttttattttaggtttaagaggcacatatacaggtttgttatatggataaattgtgtgttgagggggtttggtgtacagattatttcatcacccagctaataagcacagtacctgagaagtagttttttgaccctcaccctcaagaggccccagtgtctgttcacttcttcgtgtccatgtgtactcaatgtttagctcccacttataagtgagggtatacagtatttgtttttcagttcctgggttaatttgcttaggataatggctcccagatccatccatgttgctccaaaggacatgatcttatacttttttatagctgcatagtattccatggtatatttgtaccacgttttctttatcgagtccaccactgatggtcatttaggttgattccatgtctttggtcttgagaacagtgctgccataaacatatgcatatgtgtgtctttatggtagaatgatttctattcctttgggtatatacccaataatgggctggctggattgagtaggagctccgtttccagttctttgagaaatcgccagactgctgtccacagtgactgaagtagtttacattcctaccggcagtgtataagcattcccttttctctgcaacgttgcccgcatctgttataaaatgaggtcatgttattgaaatgtgtagtatctctgaatgtgggcactctgtggctgtcatacaaagagacacttgtcagtatagagtttggggtgctccggcatcacctgctcagattgcagccttgctgtgagcatcggaaagtgtggcgccaggaaatcacagaaaagcctagtttcctcctttctggtttcccagtttttcacttaagtcccaaattggaattggcagactttttctgtaaagggctagataggggctgaaacgaaactttgctacaagtaacagcaagataaacactacaagtcaaagagaattaaatgagaagtgcttatcagtgtcagaatgctttgttactcagggattgtgtagtcttggctggctgattgaaattgcaactgggtaaaattcctaagcgctggcattgcctgatagcacagccccccacttcttgggttcgggacacctgactgtcactcagcttcccactttgactttaactctagacttcagattctccaaacatgaaacaattatgggttataggctgttgggggtggggtgctaggtatgggggacacagagataaatgagacacagcctttcctcacaagaagctcagagaagaagagaaagtcaggcaaaaattatatagggagtgctctgtgtaatagggcatatgtaagggccagtagttgcgtgatggggtggtaatcagttctttttagtagtgggagagtaggggatgatgaatgattctcagaggagggcgtagttgggtgagtctcaaaggcctcttagaagttaatcgagtgggtggcatgagaagagggggattggatccaagcagaatgagagagatgcgtgacatgtgcaaagcgtggaggcaggagaaagcgtgtctctaaaggcatcagccctaagtcactttcaccgagaactttagaattttgctggggaaaagaaacagaatagacaaagcccagtggctcatgcttgtaatcccagcactttgggaggccaagaggggcagatcatctgaggtcaggagttcgagaccagcctgggcaacatggtgaaatctcgtttctactaaaaatacaaaaattggctgggtgtggtggtgggcacctatcatcccagctactcaggaggctgaggcaggagaatcgcttgaacccgggaggcagaggttgcagtgagccatgatcacaccactgcactccagcctggcgacacagactccattcaaaaaagaagaaaaaatgaaacaatcttacattattcaaaactaacatagatagtggaaaggattgtaggggagagaaataacttgagatagggaaagattaatgatggagatggaaaaggaactggttcttgaagatgggatacaattttcttggcaggaaaagaatgagtgaattcttggttggggaaaaccacgaggcatgaaagaaggctgaatatgctatagtgtgaaggtttgggtcatgttttggaccagataacttgaaaaccttcctgatacaaacatttagaaaaggagatgaatcgaaacacatcttgctggtaaggaagacacaatctaagagtctcagaatgaaaagaggacggagaaggaaaacgcggagcgtgtgagttaagtgatatcccccaggagagttaccactcgctgggtcctcgggcctgaggctttcatgaccctgtgggaacagcagatgagagcttgggcgctctgaggtggggggttgaacctgagacccctgatgaagctggctccatcaaaggactgcacccttaggggagagtaggcagaggaaacctccacccactgatgcaggaagacaacatagaaggttgcccaactctgtttggctttggaggttggggggcaagggaagacttcccttataaccatgggacccaaatcaaatagcctggaagcatgtgagcaggtgattgaatgtacactaccatggaatcaaggaactctgataatctacccatcaagggcttctggaccagggagaacctggaggtgcctgggaagctcctgcagggccgtggcaccaacttatgctgcaggggattcccccggataaagcccctctgagaagacgctcacgacacaacagcacaaaacacacaaggaggcagtccacgcagaccaagggacagtcatgccacacacttcaaaaatacccatatcaggccgggcgtggtggctcatgcctgtaatcccagcactttgggaggccgaggagggcggatcacaaggtcaggagatcgggaccatcctggctaacacagtgaaacctcgtctctactaaaaatacaaaaaaattagctgggcgtggtggtggggcctgtagtcccagctgctcgggaggctgaggcaggagaatggtgtgaacccgggaggcggagcttgcagtgagccaagatcgcgccactgcactccagcctggacgacagagcgagactccatctgaaaaacaagcaaacaaaaaacaaaaccgtatcagcgttgttgagatagaattcacagcccataacatccacccttttaaagcataccattcagtggcttttagtattttcagagagttgtgaaaccatcaccactatctaattttaggacatctcatcatcccccaaagaacccccacactgattagcagtcattgcttgttcacccctttttctagcccttgactactactagtcggcttcctgtctctggatttgcctattccagacatttcgtataaatggagttacacagtgtgcggccttttgtgcctggctgctttcaggtagcatgatacctcccaggttcagccatgtcgtagtgtgcatctgcacttcattcttttttattgctgaatagtatttcattagatggatataccacgcgttttttagcagagattctgagagcgtgaggtgagtttgagcttgcacagatttgtgtgcctcagctgcagctacactcagaggtgggatttagttgtttacgtgatgctcaggtgtaggatttcttcagtggctgatggaaggagccatgcagctggaagtgctgtaggaatgtaatttgtgggccacagctgttggtaagacaaataggacacggaagctatgagacacggggagcctgcatggaatgagagcatgtgccccacaagaaggaacttgagccagagtggtgactatgaatgtggaagaaggaagaacgatggagctgttattaaagaagaagtagtgtggcttagtaattagctggatagagtaaaaaaaaagattcttgagactttggaaccatgagtggaagtaggaaaccctagaggagaagctgatttgagagagaaatattatatgagtttgttctcacactgctatgaagaaatacccgagactgagtaatttatgaaggaaagagatttaatggactctcagttccgcatgtcttgggaggcctcaggaaacttactatcatggcagaaggcaaaggagaagcaggaaccttcttcacagggcagcaggacagagtgagtgcaagcaggggaaatgccagatgcttaaaaaaccgtcagatcttgtgagactcactcattatcatgagaacagcctgggggaaaccgcctccatgatttagttacctccacctgctcctgcccttgacacgtagggattatggggattaaaattcaaggtgagattcgggtggggacacaggcaaaccataccaaatattatgtattgagttttcagcagattaagactgaaatggcagtgaggtggtgaaggtattcagatggagagcctggaggtatggacttgggagaccccaaaacagatgtggtagttgaagaatggataaaactccttcagggaagaggagagagagagggaggatgaaaggccaaaaactgagccttaggccaggcatggtggctcacacctgtaatcccagcactttgggaggctgaggcaggcggatcacctgaggtcaggagttcaagaccagcctggccaacatggtgaaaccctgtctctactaaaaacgtaaaaaattagccctgcgtggtggcacgtacctgtagtcccagctgctcaggaggatgaggcatgggaatcgcttgaacgtgggaggtagaggttgcagtgagctgagattgagccactgcactccagcctgggcgacagagggagactgcatctcaaaaacaaaacaaaaactgagccttagagtgtatcagatttggtaggaggaaaagtgggtgatatgcatgtgatcaacaattctacaatcaatgaagagaaattctggtgaggggatttagtactctaagggtagcccttgttctgagaaaagctgctgctcagggatggccgtcggccctgtgtggtggcgttccccatcacagggtgttcacatgcattcctggggccacctggaaggacccccagaagcaggtcatgcagaggttggcgatatgagctgcttgatgctggctactggataccaggagggaggtcgatgctgctgagagtgttcagagttcctacggagcagacttgtgtcattgagagagagacagcctggcaaagcaaagcctcagctaatcctcagtgcagtagtgtttatgatttagcaatggcctggcaaactctccttgaatttggctctggaagatttgcttctgtgaggacaaagcagtcaccctccccagatatgaacacttggcatttggcattcttgacctccaagaacccccctgggctggccctctctctgaattggggtaaagaagaggaagttctcacagtcactgttttagacactgttcctttgattctctgaaatctcccacttttgcttagatgtggtcatgatgcacatttctacagtttgccaaatgacatcagttgctgatgtttcaagaaagatggataagtaaaatttgtggggagaggggagccaaattaaaattaataacaattaagagctctttccccactggtagcaaaaaatgttatatttagtggtgccatagtctgtgtcttagtccattcaggccactatggactcatatatgtgccatagactgagtagcttataaacaacgaaatctatttctcacagttctagaggttggaaagtccaacatcaagatgccaacagactctgtgtctggggagggcccaccttctgggtcatagatgcaagttctccgcatgtcctcccatggtggaagggagtagctagctagctcactggggtctttcataagggcactgatcccaaccatgagggctctaatttcatgacctaattacctcctaaagtccccatctcctgggaccatcaccttgggtgttaggatttcaacctttgaatttagggggacccaaactgtcccttgtgtacccctaggctttgccaaattcttagcttgaagaaggatgttctgattaaccaaatgtaaagtcagataattagtgatttcccaatcatctcttctaggtgcacgtgtaactggaaagggaaggcaaaggccaaggtaacaagacaaatatccaggaggagagaccgggctcatttctggtgggctgggcagggctgggttgatggcagcagtgggctgaagggacctagtgctcagagatgttcaggagacagttgtggtcactttgagaatgtgctagactgaaggaaaatacctagaagaagacagaagcatgtttcaggggaccaggtgggaaaatggggtttcagaggtcagattaaggcatagcattggaattattctccccctaacatcctgtccactggctcagatttctgagatatggagcacatctgaaacttcagccaacctaccccctttatgactggctagaacttagttctgaggccattttgcttttcttccccaggtaattgaggcagacagagtaggaagagatgtgaggtttctacttaaccctccttccccatagatctaagaagcctctactgccttctctgctctggactctgtagctatccacatccaatctagcacaaataaggaagataagaaaaagtaaccagagcacctctcaatccccaacagttaagttcacccgtttttataatttcttccctcttgcaacagaaatctccgtctccagtctcattggcgaccttaactaagagtctgggaagatggaaagagacccaggaacagtgtcactctccctgcctggtggaggggcctccacttcctctacatattttcttgtatatacaatctacatttgtggatatgctgtgtttacttcttaaataattgttccatgattttacgtggagcatggctttttcccagcctgtccatatctttgtgtttcatgttctcgatgtttgtgaagacacatctctgggaatttataatgagaggtgtaggatggaccaaagccagggagagaggaatcgtgagaacttaagggagagggaaaggcgatcaggtcaaaggcagatggagagtccgacaccaaaacacctgtacaatgaaacatgcggggatctagaatccagacctgcagtaggacaatataaacttcagatttagaccaggagtgagaaaccaagaactcaatcattttatcagttagcgtgtcagaacagcggatgggagacaccagttacacacagagctgaacctctcttggtcagcatcatcctcttacttcctattagagcaagcagccatgcctggggttcacctggagccaagagttagaggtaggttgggttcttgttaaggctgtcaagcctatgtactaaggctgtgttcttggctagaatgagaagtatggaattgacaatgaatgtaaatcctctgaagtactgaccttccacatgaagagaagtgggaaaaaaaatctatttctagccctgagttatttacacatcaactataaaaaatggatttgcctactatgtcgtaaagaatagcagaaatattattggcaaagagcttttcagaaaaacgtacaatgacatgattaggtaaatgtttgatacacttgtcaaagcaaagtcaaaacattagataactaatcttaacataagcagagggttaagatgagacagttcgcttctcaagttagagtaatgttatgcaaacacaaagattaatggaattagttttgtttatattgcaaaaaatgttttaatatctaaacctattcagcctttttaaaaaaagttaaggctgactttagccagaatttaatctttagcaatctttctattttaggaccagtcttgaagtggtattggtatttagaaactttacaataaaagtgttttttgtcttgctatgaagaaataatttgtttatatttttacatagatggggtaaacatatatgcaaataagtattttgaatcagagttgcgatattatatagcacaatactgcattcaaagagcatttgaaaggagactttaagcagtaaatgaaagtgtagtagattaaaataatatattttaaaatataggagccctgtgattttgcttcattgaagaaatacgcttttcttggcaatgtgaatgaaaaaatgttgagaacaaagaaaaatgttttctacatttacttctaagtgaaatttcattaaactgttttaaaatatttgaagacatatgacttctatcccaaattttccattttatgaagaaagctaattagtttctgccatttctccaaaaaatattttggccagtagaaaaatcgttctagtttcttgcaacaagatttcccttgttgacagagacaccttttttggttatcttctgtatgttacaattaaacatttttatttttaatatgaattatataatgtggttcatttcaggaggtatttgtagcagaggggcaacaaaaggaacttggcattgcacgatcattgatttcctttaggcattttcataaccccctgaagtgttacttacactcttacactatagtcaatggagtagcattcttttgtaatgttttgatttcttcttgggagccaatctgttgctagattttttagaagtacaacaatgatatggacccaaatacattatggcgaactggttcttcttactcaatttattgccttactcctaagactggggattaaaaaaaaaaaatctgattatttggtgggtcagtcacagtaagatttcagaaaagcttccttcaaattactgaatgacctgcagaatgtaacataagtttatattaccttttatagaataagtttttgtaatcttgtaatactatggacttggaatacccccactgaggcttagtggacacccagagcctggggacatcccttggcaagtcatggctactctggtctcagccatgaccgtgactccaaggtgacttgggaccatgctgtgtacgggtgtctctggggtacagagggggtgactccaaggtgacttgggaccatgctgtgtacgggtgtctctggggtacagagggggtgactccaaggtgacttgggaccatgctgtgtatgggtgtctatggggtacagaggggacaacagatctgaggctgggaaggcagacatttccattctcctcactgtgggcttaggcaagaagtttcaggttgcagtaagaatctgttgttgtgaactttgaagtcacagatagtttttaattttggttggttccttcagatggcgtgatgacggggccatactaccacccaccaaggggcactgaggacctcctgcctgctgggtcaggaaggcccaaggacagtacagacacctgccccctccccactggtgtccatggcctctgcccaccttagaaaggacaaaggctgacttgtcactacagcttgtcttgggcatatttcattttccaaaattacctttcagaaacttagggctgttttcatttgctgatcatgattctcttccatggctcaaatcaggcttttagaaggtctttgatttctttggtggaattttttttttttttttttttgagttggagactcactctgcacccaggctggagtgcagtggcatggtctctgctcactgcaacctccacctcctggtttcatgcaattctcccgcctcacctcccgagtagctgggattacaggcatgcaccgtcatgcctggctaattttgtatttttagtagagacggggttttgccacgttggccaggctggtctcaaactcctgacctcaggtgatcgtccttcctcgacctcccaaagtgtaatcccaaagattacaggcatgagccactgcacccggcctttactggattattttaaattgttcatcttaggtctttcccttaggctcattcaaaagaactgtgtggatcaatgggaaggaaaatgtcaactccctggtgaacattttagactgaggcaagtgatggtgccactcaggagaacagcgtgatcattgtgcaggaggcgtggaatggctaatgctgagttcccttgaacttggattcatctgtgatgtcatgggttctccttgtcttatgctcaaaaacctagggtttgtggcacaagagccttttgtgtcagggttagttcccatcaaatatggtttgagaaaagctgcattgtgggtacccgatggaagtgggaggaagccgtgggccgcagctggctcttccgtgggctcccttgacttcccctctgagggtcttattagacgcgattctacttgggaaatgtttactggtcattcatggcatggtagttaacgcaatggaatgcttcccctttgagggctgtgccaaaagcctgaagctccttgggctcagctttataggaaagagggagcggaagagaaaggaagaccctatctcttgtttccagtgcagcttcatgcagggcctgtggtgtgcaggacagacaccattaaagagactctgtaatattcctccccaaagatccgctagaacaagcaagaccattgccagctgtactgaagggatggagaatctgaaatagagtttacatttatttgtttatttatttatttattaatttagacggagtctcgctctgttgcccaggctggaatgcagtggcgtgatctcggctcactgcaacctgtgcctcatgggttcaagcgattctcctgcttcagcctcccgagtagctgggactacaggcacgtgccacaatgcctggctaattttttgtattattagtagagatggggtttcaccatgttagcccggatagcctcaatctcctgacctcatgatccgcccgcctcggcttcctaaagtgctgtgattacaggcgtgagccaccacacccggccagagtttacttatatttatgtcctgccttgtgcctggaagaatttaaatagaaagaaattaaaggacttacttaatagtaaatctaagatggagctggaatggacttctaagatagtgtttttaaagcaaataggcttttgttcttttaacccaagtgaagtacgtataagaagaggaattcatcaccataaaatagtattaaacagagtaatctctatcctttgtgactctagtaagaagaggaattcatcaccataaaatagtattaaacagagtaatctctatcctttgtgactctagataactagggttagaaggaatcttgtgtaatgcctgcatccaggccaaggtatgtcttcgctacccgaatagtaagaaatatattctttccgtttactaagtgtatctatctgggcgcgattttcaaaatctcccttcagtccaaacataatctggtattttttattttttcaattttaattttattatttttttatttacattttagagctagggtctcgctccgttgcccaggctgaagtgtagtggcatgatcctagctcactgcagcctcaaactcctgggctccagtgatcctcctgcctcagcctcctgaatagctgggaccacagccattgctcctagcctggaatttttaaaagatctcttctgatgacatgtggacccatgtctgcagcttgtcctcttgtgttagcagagatgacgcccattcactatggattgtgcttttaggaactggcacggaccccccaggggaaacccgaagggcctcttgtgggttgacctctgtaagaaccctgttttcctcctcagtgaggcccacaggtgccccttatgtttatcccctaggcacaggggcttggtgttcctgcctcttcctgatccgccactctccccaagacttgctaattcctccccactggcttcccagccaggagttgtcaggcagtgaccctaaccccatccccttggtttccaccccaaataagcccttgtccttgtccaagagtataaagacaatgagttgaaaactcttcttatggccccaaagagcaagagtggccttctaaaatcagacacttaatcccctcgcgaatcaggcctgtaccctgattgtattcatctccatgaaaactgcgatacatatgatcatacattttatatgcctgttttagaagatctccagggaagacatttccacagccccctgtggtcatcttttaaggaattaacttcatgactccaacatgtatgttttgggggtacctgtctcaagcaggctggcctctttctagcatggaaggcccctagagggagcttagaggacacgagcgtggcttcctggggtgcccagtgtctcttccttcaggcctagttagttggaaagagcattgagggtaagtggtgaccagctgtgtccatcacctgcactggaagagtctacagctcttcctagccatgatcatgcagcctcaggattgggagggactctgaacggggatcttgtccagtccctgaagtgatgttcccttttcctctggacaggctcagaggacacaacttctgcctctctgggcatcctctgatctgtctggaatgtgcttaccctgttctctggactgtgctcctggcagagtctgactgcatttcagttcgtcttcagcatctgaacacgatgtgcagaaagatcagctccagcccctcacatgaacccttctgtgtggacgctcctcctctttcctcttaagcctcccacaggaggcagagctcttggctgctcagcccattggaggtgggaaggcaagtcaagggttaacagagccagtggctgcagtctgcaaggattggtggggccaggtggctgcagtctgcaggggtgaatgaggttgggtggctgcagtctgcaggagttagtggaggaggtggctgcagtctgtagggatgagtggggctgggtggctgcagtctgcaggggtgagtggggctgggtggctgcaggctgcagggatgagtggggctgggtggctgcaggctgcaggggtgagtggggctgggtggctgcaggctgcaggggtgagtggggctgggtggctgcaggctgcaggggtgagtggggctgggtggctgcaggctgcaggggtgagtggggctgggtggctgcaggctgcaggggtgagtggggctgggtggctgcagtctacaggggtgagtggggctgggtggctgcaggctgcaggggtgagtggggctgggtggctgcagtctgcaggggtgagtggggctgggtggctgcaggctgcaggggtgagtggggctgggtggctgcagtctgcaggggtgagtggggctgggtggctgcagtctgtaggagtcagtgcctgccccctctggaatgagggcaggagtccatccacatggttctcctctgagtgggaatggagccaccgggaggtgcctgggctgccttccctggtgcacgcaaggacaagttgcagctgaggccttacaaggtcataaggagcctgtagctgctgagctgagggaaggagggtagagagattgaatagctcttcctaaagcagaatatccgtcctgtggggaaaaaaaaatgccagcttaagagctaggcgggtccctctggaggttcttggcacactgtgaaggatccccaaggatgccagcagctaaagcagcagctctgccatgggtggccttcctggcaggcccccatgcagcctgaccactctgggcccagcagtgtgcagcatggagactctcaggagggcctgagaactgggcccagcaccccagcactgccccaccaccgccactgcatgctgctgtccctcccatcccagccggcaccttcagtccttcctgggtggggacacctggactgtgagtgcgcagggtctgtctgatgctcacacaggctgtgctgagcccaggatgaaccagggtgagaagggcccagcaccctggctgaggccgcccctgcctgtggagtgcagttctccgagttattgatcatcactgcagcttgtctatcaggcagcttggagcttcctgcacatcctctttctcagtagtgtctgtcttaggttctcaagggctgggctgtgtctcatgtcccttgaattcaccaacagaacctctctgtctctttctcctcccctctattttcctctttcccctactctttctgtttctctctttctctctgtccctctctgagtattctgtctgtctgtctctgtctcctctatctctgttcttctctgtcgctgtcttatttgtttaataatacagcagatatttactaaaagcctacaatgtacaaaatgccatgatgttgggagggtggggcagggcaaggggatggctgttttgaggaactccctgtccagtgtgacaggtggatcatttattcactgctcacttattcagaacacatttgtcaagcatctcctatgtgccaggcactgctgggtattaaatatagaataataaatatacaataataaaccagaaaaagtgtctgggcatggtggctcacgcctgtaatcccaacactttgggaggctaaggtgggcagatcaccaggtcgagagatcgataccatcctggccaacatagtgagaccctgtctctactaaaaatactaaaatcagctgggcatggtgacgtgcacctgtagccccagctactcaggaggctgaggcgggagaattgcttgaacccaggaggcggaggttgcagtgagccaagatagcaccactgcactccagcctggcgataaagcaagactccatctcaaaaaataaataaataaaatacataaataaataaaacagaaaaagctcctgcacacagaagcatagactggagatggacagaccagtcaatgcacagagagagaaggatgttctgtatatcaacgtgaaaggagagagcaggggcccatgctttggggaatggtgggcagggctgggaggcagggaagggctctcttggaagttcatgtgtaaacccaggattgcaggacaagaagagacctgcagcagcaaagactgagaggaagaggaagggagctccaaggaaaaaacagcaggtgcaagggtcttggggagggaaagagcttgcagaagtcatggcggcacagcgtggacattgtgtagctggggtacgtgtcagccagtgcagcatcggggatggagctgtcatctgtcttcactgttgagttaggaatggcctcaccaaggaggggacatatcaagtgagttttgaagggtggctacagctcaacgtgtcaggaaggcggggaaggagggcagcccctggtgccaccacaggaagtcacgagaaagcagggtgggtttagggaagctgggtgtgggcaaatcagaccttgttgttgatagctggggtagactagcaggaaataaaagacagggatttgaaccaggaccatttattttaatgaggattttgtatccaaaaagagacattaggccaggcacagtggctcacgcctgtaatcccagcactttgggaggctgaggcaggcagattatgaggtcaggagattgagaccatcctggccaacatggtgaaaccccgtctctactaaaatagaaaaaattagctgagcgtgatggcgtgtgcctgtaagcccagctacgcgggaggctgaggcaggggaatcgcttgaacccgggaggcggaggttgcagtgagtggataccgcgccgctgcactccagcctggtgacagagcaagactctgtctcaaataaaataaaataagagacattagactttatgctgagggcagcgaggggccatggaaggctttgaagagaggagggttgaaaatccacgtggcagtaatgcagagccatgctggctccttcctaaagtgcaagccctttgtcgctccgcttccacgtatgggaatttatcctaagggaagagtcttgggcacaaagacgtggggataatgagcttcccagcagcgctgctcagatattgcaaaatattaagacatggtggatgcgtgcaggaggatgctgggttgctattgaaatgacgtggcaaacatttctccattgacatgaaaaccgtatatgatacgttacagtaaagagaaactttacagcacgatgtatgtattatatgatcccacttcctttaaaatcacacgtgcacacgcacacagccggggatgtttctgaagtggtgtgtggcacaccagcattttagtagtggttgtctctaggtaggcgtgatgatgtgagttgtatatgtttttcttctgatctttcaaaaaatgagtaatatttttgtattaagaaaaaatacaaaggaagtaaaggaatatcagtttatggtcacagggatatttagggagaggagttggaattccagggtggtgttgaaggatgtgagggcctgacatccaggcttccgccttggaccacgggtgaaggttgcagtgtcctctgtcccgggacagagagcagcgaggagagggagatttaaaaagatgaaggttccattctccaccgagtcgagtctgagctacctgtgggacacgcagggagaaaaggttggcaggtcggtctggatggaacgagaggccagctccagagataagtctggaagttcacagatgacgatggtagttggcaccatggggatggatgatgtcacctggaggtgagaacctcagctgagaaaaggaccctgtgactcaccctgaagggccagcgggcggggggtgggggacaacagcaaagcccaggggagcaccaatcccctccagggaggagccggggaagctagagcaggaggagtttcaaggagggaacagcatagacttgacaatgtcttctgcagagtgctggcacaccttgggtgtggattctgtttatttgcatgggatactttgacgtatttcctgggggtgggagccaggcatgggagaggacgggaaaccgctgcagtcagcccctctgaacaagcagagtgtcgggggataggaggagggaatagcagaggagagaacagagaatagtggaggtctccgagccctgggaatggaaaggagcactccattgctgttcttttctccccgaagaacttgttgcattcttcagtaggatgagaaggtgggtttaatgaaatatgttcattgttcttgtccctgggcaggtgcaaaaatcctgcagtgccttcatttttttttgagatagagtctcgctctgtcgcccaggctggagtgcagtggcatgatcccagctcactgcaacttccactgcccgggttcaagtgactgtcctgcctcagcctcccaagtagctggattacaggcgcgtgccaccatgcccagctaatttttgtatttttttagtagagacatggttttaccacatgggccaggctggtcttgaactcctgacctcaaatgatttgcccgcctcagcctcccaaagtgctgggattacaggtgtgagccactgcgcccggcacctgagtgccttctgcaaggatgttacaggagatggatacattagttgatgccagaaatgaagcaaaagaaacaaagaagtaaacagagcccatcaacatacagggacttggaagagatccccagatttgctgcacgttaaaagggtgacagctctgagccatctcggctccagccgtcctggggctgcagattctgctgccgttggtgcacgtgctgtccctgaagtcagactccctgcattttaatccagtctcccatggagcatgatgcttagccactccatgcctcagttgccccatctgtaaaatgggaatactaatagttactttccctcaggtggctcgtaagatttagaattaatcacctcaacagaggaagagcctgtacactccgcatatgcctagggagtaggaagctcccgggaaatgcaagctgttaatatcgtcagcgtcgtcatcatcatccttctaatgataccatcaactccattgctttctcagcctgggaatgaagaagtgctgggaaagtggaggaacattactttagcaaaaactcacggggagaaagttaggcgaacgtttgctcagccaagaaactcttagtttactagccctacagaaaagaatataatgtgcagatgtgttttatttattttttgagacacattttcactctgtcacccaggcagagtgcagtggcacgatctgggctcactgcaatctccgcctcccaggttcaagtgattctcccgcctcagcctcctgagtagctgggattacaggtgggccaccacgcccagctaattttttgtattattagtagagacaaggtttcaccatgttggccaggctggtttcaaactcctcacctcaagtgatctacccacctcggcctcccaaagtgctgagattacacgtgtgcaccaccatgcctggctaatttttgtattattagtggagatgaggttttgccatgttggccaggctggtctctaacttctgaccttaagtgatccgcctgcctcagcctcccaaagtgttgggattagaggcatgagccaccgcacctggcctaatgtgcagatttaaaaatagatgcattgagaatagttttctgaagtagaatttgaggttcctacaaattcaagttggacagtggaatgtgggatgagcagttggattcaggattgaaaggcggctgaggagtgaggaagagagaaaattccagagggaaaggatacgaaagcagtggttatttcacctagccagaggggccgacggggccatctgtctgaacctggggaaggaggaaaggcaaagagtcatgaaccggggaagagacctacagcgtgtttcaagggtgtcccagagccacttagcacatgtccttctggaaaccaccactcccgacttcaccgtttctcttaagctctgccggggctttccaccagccagcaagtaacagcaaacccatctagaactctgattgtgtggctggccctgctcagagcccttttcatctcgattctgatttaatcctcatgacaacctgatgaggcaggtactattactgtcctgattttatggatggggtaacttgggcgcagtgatatcagagagcgagtaagtgagggagcttactgctcagggccccagggccccacggagagtcggggatgaacccagcctcaagggtgacagctggctctgaagcctgtgctcttcaacttcgtaaaggtgccggatgtcctttcatggtcattatataatgaaagtccctgacctcctatgctgagcctgtaagtgtctaacaacagtgctgcttgggaagacagagtttgctcacagtgtctatggattactatagaaaccttttctaggcccctagagtatttctggtttcaggtcatatggcttctttcttctttccattcgtcacagctgattttagtgtatacctgttatcactgagcatccctgatctcacctgtattacttcctggctttgctcaaactgccttccttctcttcagaatgcccttccaagccgggtgcagtggctcacgcctgtaatcctagcactttgggaggctgaggcagatggattgcctgagctcaggagttcgagaccaccctgggcaacatggtgaaaccctgtctctactaaagtacaaaaattagccagacgtggtggcgtgcacctgtaatcccagctactcaggaagctgaggcaggagaatcgcttgaacctgggaggcagaggttgcagtgagctgagatcgcgccactgcattccagcctgggtgacagagcgagagtttgtatgaaaaaaaaaataagaagaatgcccttccagttctttcaatgtattctttaaatctcatcctcaaattcctctttctctgtaaggcctcatgtcactccagcccatagtaataatcttttcaattcctatggtatttattatttgggcatttaattttataattcattaaacgttcattcattcattgattcacctgcctcacctttgtctagcacctccttcttgtcactagctgttaggaagatgaaggagaccctcctgcaaagaactcacaaccgagtaagggaaggagataaaacaatcatcatcgtgtgatgtgtgctttataataggaatgcattgagggctttgccagcctaagggagggaatgatcagctctcttcagagaagtcagaaaaatttccaacagagaatttgcacacttgcctggctcttaagaatgatgaggggcttgtcaagtgaaagatggaggtagggtggtggggaagaacatctggggtcaagagaacagcaattgtggagatgcggaggcccgaagtaccgtggcgggatgcggcattcagcactgattcactcgtgtctacaaccgtaacatctttataccattttttccagctgggtaaccaattccttgacattcagccaagtgccctttacatagctgacactgaatttgaaccctgacatttttcctggggggcgggggcggtttctagaacaggggacaagtggacttatgtgagcagctgtgactggttttgcttttgtgtttgcctagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggtaaagatgacaccttcttttcacattggcttggctttgaaataatgtttttttttttggtttttttttttttttgccaagagataaggatttgaaagctggggttgatggcaggaagggagactgcaggcgagagctttctcagcagcttaggttgctcggaataccaaatccgtactctcctttcccagtctacaagtgaagctggtgaagttctgggggaaaataacctgataggtgtttggaggcttgcctggttcatctcatggatcctgttagaaaaagtcttgctgatacaaaaacaatactgtttttgtaaacggttttggggtggagaattacagccacgtggaccagccagtgtttcgtgcgcaccttgggcaggggcaggtggaactgctttgcaaaacaaggagccctcttggtagagctgcagcagagtgaaacaggtatcctggtggcccgggagggttgcggaggtaaaatgtgatggggaggatgtgggctctcagccactgcacgcttgtcttgggtgttgcccaggtaagggtgcagaatgttaagagaggagagaaaagatcataaaaattctgagaagagtggagaatcagagcagtgtgttaccagctgtcctagatgttaagttctcccaactcaggacctgcgccttactcttgccattccctgtatcaacagtacagtggacacagaagaggtgctcagtattggagcatttagcagaacttgacctactccctcccccttcctttcaggctctgtacagagacaccacctcctggttaattccacttcagttatctggaaacatacaaaacactctgttcagtcttctcccatctgggattttccatctttcttatattcatggtttcccagtccaagacaaagccctcatttcccaaatgaacttaatgtggaacttgatcttgctgggctggtactttccatttacactgggatttcctactagcctcccaaacagtataatctaggaactgttttggtgtttgatgggagaaatagaagattagatttaatatgatagtgatgctctacggcaggaagtccacaacaccataaaattcttgaaggaacagatttctcttcatgtttacatagctcctacctccatgcacagttcctaacacagagggcatgctcaatggatatttgtagattggatttattttaatggccctgcttactagcagaatgatgtgtgtgtgctggtggagtgggggccatggagtaataaacagctttagaaaatggctgggccgggtggggtggctcacacttgtaatcccagcactttgggaggccgaggcaggtggatcacctgaggtcaggagttcaagaccagcctggccaacatggcgaaaccccatctctactaaaaatacaaaaagttagccgggtgtggtggcgggtgcctgtaatcccagctacttgggaggctgaggcaggagaattgcttgaacctgggaggcagaggttgcagtgagccaagatcatgccagtgcactccagcctgggtgacagcgagactctgtctcaaaaaaaaaaaaagaaaaaaaaaagaaagaaagaaaatggctggtgtatgttatgctcttttggactccaagccttagaaaccctgtgggtttcctttatttttcttgaactgcattgccctagcctctgcaggtgaacagcagatcagcctgcttctctctaagacgtgtagcatcaggattgtgagcatggatttggaagccagactgcctgggtttgaatccagctccatcttctctgtgcctcagtttcctcatctgtagaatgaagataacaatggaatcgttaccaggatggagtgagttaaagcatttcaagtggttagaatggtcctggcacataggaagtcctctttaagcatcagatgtggccattattttcacccactcaggtaacccctctcgctggtgcttgtgagtcctttgatgacagctcctgtctgttttcagtgggaaggagatgccccagttgctgtgggcttgataccaatccctgcagggcctctggtggctgtgtgccatcgggaaagctaatccgtccctctgcctgtgctctccttggctttaaagtggagtgagagatttggcaccattgctgaatagagacaagagaaaaaaatgccagttcatccttgttcacacatccaggggcactaagaaattagactggaccttaagaaaggcaaattaggccaggcgcagtggctcatacctataaccctggcactttgggaggccaaggcgggtggattgcctgagctcgggagctcgagaccagcctgggcaacatggtgaaaccccatctctactaaaatacaaaaaaatcagctgggcgtggtagcttgcgcctgtagtcccagctactggggaggctgaggcaggagaattgcatgaacctgggaggcggaggttgtagtgagccgagatcgcaccactgcactccagccccggtgacagagtgaaattctgtttcaaaaacaaacaaacaaaagaaaggcaaattagtgattccaataaaatgtaaaataactttctttccatttgggctctgcatcttagcaagaattatgaacatttggtcatggacatagccttatctacttttttagctagaaaatctggaggatgttaagccgtgggggagatgatctggttctctcagatgcggtacattttaattttaatttttaatttttgtgggtccagagtaggtatatgtgtttatggggtatatgaggtattttgatacaggcatacattgtgtgataattacatcagataaatgagatatccatcacctcaagcatttgtcctttgttacaaacaatccaattatactcagttatttttaagtgtatcatgaaattattattgaatataatcaccctgttgcactaccaagtactagatcgtcttcattctttctaacttctttttgtacccattaactatccctacttctgccccaccccccactaccctgcccagcctctggaaaccatccttctactctttatctccataagttcaatcgttttaatttttagctgccacaaataagcgagaacatgggaagatggtctttctgtgcctggcttaattcactgaatataatgagctccagttccatccatcttgttgcagatgacaagatctcattcttttttgtggctgaatagtgccccatggtatatatgtaccacaaatgtggtaaaatttgcaggtagagaaaagtcactccagtcaggatgatggatggtggtgatggtcatcaaactctaaatttactacaaatcatgaattggacacttagaatgggtgatcttttggtatgtagattttatcttaagccattttaaaaaaaaaacaaaggaaataggtgttcacactacagtaaggtctctgctttacttggtaatggtgggatgttggtagcttagtccagtggaattcttagctaacccagaaacctcactgtagctggggtttcaacctcaaccacccaaccacctgtctccccatccaccaaacaaatacttgttcagctcctatcaaagacacaggccccaactttatttatttattttgctcccaaacttaaattgtctgatttattttaatcataaagtagtaaatttaagaatacatggggccaggtgctgtggcccctgccagtaatcccagcactttggaggccgaggcgggcagatcacaaggtcaggaaatcaagaccagcctggccaacatggtgaaacccgtctctactaaaaaagtacaaaaattagccaggcatggtggcgtgtgcctgtaatcccagctactcgggaggctgaggcaggagaattgcttgaacacaggaggcagaggttgcagtgagccaagatcacgccactgcattccaccttgggcgaaagagcatgactatatctcaaaaaaaaaaaaaaaaaaaaaaatacatgggtggccgggcatggtggctcatgcctgtagtcccagcactttgggaggttgaggtgggagaactgcttgagcccaggagttcgagaccagcctgggcaacatagtgagaccctgtctctaaaaaaaaaaaaaaaaaaaaaaagaaggaaaagaaaagaaaacatgggaacattctttttaaaggaagcagtaacctgtagtgtaacatacatgcagaaaaatgtacatgtagtaagtgtacaacttgatatgttttcataaactgaacagaacctggacccagatcaagaaacagaacatttagaactccagaagcctgctcatgttctcacaccattttttccatggaagtatctattctaaaacatttgaggaataaagaaaatcatcaaaagaaaaaaaggagagaaaaacctcctgctgtccacagatgcctgctaatgtcattggtgtttattgttccatcatttctcagagttgagatttgttttctgtttcgtatggtttttctaagccacatattcctgataaaatttttcttccctttcgcccccaactttattttatttattcatttatttattttatttttattttttctgttgagaccgcgtctcactctgtttcccaggctggagtgcaatggcacgatcttggctcactgcaacttccgtcttctgggttcaagtgattttctgaccttagccatccgagtagctgggattacaggcatgtaccaccatgcccggctaatttttgtatttttggtagagacagggttttgccatgttagcgaggctggtctcgaactcctgacctcaggtgatccacccaccttggcctcccagagtgctgggattacaggcatgagccaccgtgcctggctggcctccaactttaatcagagctgttgctgacaagggcctctgaaggaaaaagggtggccaggaggagaaatatttcatggctcctttctctgtggggttctggcaagcagaggtgatctgaagggacaggaagcaaagaaaggagagacgatgaaggcaacaaattcattctttcatcagctccacctagccctagacaacactggaaggcatctgagatgtcagcagctaccctcctcctcttcgttccatgcccctcctcccctctgcggctctttctccctccacattcctgctgtcttctatgctcaacaccttcctgctcttttcaaagccattctcagaagagggcacagaagccattgaagctcaggtaagctaaggcgtcgccacatgccttctggagaaggtttgttacagtgggataatccccattcacttatatgcatttagtaaatgcacttgcttttagcaagtttctggatggccccttaacacctcactcctgtgagcatttgggtggttgagcgtgaactgcagctatgaaagtgcattcaggctgggcatggtggctcatgcctgtgattccagcactttgggaggccaaggtgggcggattacttgaggtcaggagtttgagaccagcctggccaacatggtcaatcccatctctactaaaaatacaaaaattagccagatgtggtggtgtgcacctgtaatcccagctactcgggaggctgaggcgggagaatcgcttgaacctgggaggcggaggttgcagtgagtgcagattgcgccattgcactccagcctgggtgacagagcaagactccgtctcaaaaaaaagaaagtgcaatcagagtgcggaggtgagtgcagaggcttgagctgttccgtgttggtgtcctgcaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggtctgtggtctgtcttcgtaggcatgagaggctgtttgaggggctgaggggtggctgcggtgggaattcagagaggagtgtgttgctgcaccccagccttgcatctgctgacaacgatcatagctcattgcaatgggaggtgtcaccatgtgttttgaaactaggcagatcagagttcgaattctgatcctcctttatgactttaggcaagattttttttttttttcttgtgatggagtttcgctcttgttgcccaggctgcaatgcaatggcgtgatctcagctcactgcaacctctgcttcctgggttcaagcaattctcttgcctcagcctcctgagtagctgggactacagtcacacaccaccacgcctggctaattttgtatttttagtagagacaaggtttctccatgttggtcaggctggtctcgaactcctgacctcaggtgatctgcccgccttggcctcccaaagtactgggattatgggcgtgagccaccacacccggccctaagcaagattttaagacagtctgtacctccgttttctcatctgtaaaatgaggattatggttggttgcagaatttaatgagaaaatcgctatataaaaacactatgtatagcactggcacagtggccatcccatattaagtatttaatgagctctcatagttcattgacatcctgatatttcaaagcactttctagtaagtttacttttattctaccctgtgagcaagtagcagagtactgttatgttcattttgagtactagttaaaagatacttttatttggaagcaaaaccatcagataaaactgttaaataatcagattattttgaggtggagaataaatgagatcttttaaatgagagatggagaaaactcagatcttttaaaacagaaatagcttccctccgatattatgttgccacgcatcagtctgctcctttgctgttcattgagtgaagtgccagctcccagttcagcgtgaggtgctttaatctgcatcgtggcatatgtggtatctacttaaaagcaaaggggaggtttgggtagatttataggtgtttaatagccatagtcaaagcacatttattaatgataaatggaaatggagacacctaaggtgtgcagtaaagacaggtcctcggtttgggattcgccaccgtttcctcccacgcattttaatgaaagatttaaatgaaaacacagatttgctttccacattttaaaaattattcaaaactagagtcaaaggggagaatctgatacactggataacagaattgaaattcaataaggcattcagaagcaaaagcagttatgctgtaacaagtcagctgcactgccatcccactgaaactatgatcgatacctggcatttatgagaacttatgatacaccaggaacttcgatgtgcatcatcccagatgatcctcacagaaatcctaggaggtaggtgtattagggtaaaggctaagctgcaatacagagatgatgaaaggcaaaggctgaaataagatagccatttccttccctctcctgtaatggtaacaggctagatcctgctcccagaagtcattcagggacccaagctccttctgttttattgctctgcttccctcaggtgttgtccttaatgctacaggattgaaattcagtcactatcactcttgttttctagccgcaaaaagggagagagaaaagaaagccagcatggattgtaagcaaatattgagaagttgcacatctcactgctacccatattccattgggaggacatagtcacatagccatttgtggcctcgatggaggctgggaaatgtagtttgtagctggatggccggagctcaattctcatgaaagaaggggaaaatggactttcagggacagctagtaggtgaccaaagaagtactgtttacatcctgattttctagataaggaaactcaagttcagagaggttaagtcacatgtcccaagacacacagcaaggaagcaacagagatggaagtctaactccacagcctatggtttctaggccttttgaaagggaattttaattgtctccttacttagcaagaagcgaccatgcaacttaactacaaggaaagcaaatgcaagcaaatgttatacgcacaaactcacgaaagtcaggtttctgaagtagaatgcgctgcttaaagcacatctggaatttgtatttggttctaagaaaaaggtttttaagagtccctttaagaaacgtaagtgtacacaaaggaaatttaccaagactggtgagggaatcttgaaattgtatcacaggaagaatagttcatgaaactggggattgactgggcttaaaggaatgcacagcattgttttttaagcatccaaatgtctgttgaaatggattacactaattcgatattgttccagaggcaaaactgaaaccagtgggtggaaatttcagggaggaagattttaatctactataagcaggttttttctcatcatgagagtggttgaaaaacagctcagaagccgcgtgagagaatgcattccctctcaccaatggtgttcaacctgctgcctagtgatctcctggcagaaatattgtgtggggtgccatgttggactcaattgcttctaaaatcagatgcatccccctgagagtctgcagtttcctttaggactgtcctgcctgctgtcagagcagggccctgatctccctccctccctgtgcttccactgcaggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggtacgaggcacctgtgccagccaggtgtgggggacgcgggcctgagataccactcacctcctccacaggaagccccagcaggaagctgtgttattccatcttgctataatacttataaacaataacccagaccgggtatagtagctcacacctgtaatcccagcactttgggaggctgaggtgggatcccttgaggccatgagttcaataccagcttgggcaacacagagagaccctgtctctacaaaagaaaaaaaaattaattatctatgtatggtggaatgcctgtagtctcagctactcaggaggctgaggaaggaggatcactggagcccaggagtttgaggctgcagtgagccatgatcgtaccattgctctccaacctgggtgacagagcaagaccccgtctctaaaaaaacaaccaaccaaaaagcaataacactatatacagctcataatcttcagggagtattgtagactgttgtatgtgcattactatacactgtggctgtctagagaaatgagaaaaaggtggcatttggttcagaaatgtcacctagtgaagtcagtccatcaataaagcatcaataaactgagtgcttgccaggtttcaggcatgggcggaagcactgaaatgaacataccagtgcccatttttcagtgcctttctatattttcaagcacttcagagttatgtagtataatttaattgtgtgcttgattttatttccccgagagcatgtgggaaggaccaaggtacggattcttgcaagaatccggtctttccatgtcagtctctgagaatctgaacagaagcaggcacagtcagtcccggtgccattctgctgcggggatgagtagagacgagaacaagagaaaggaaacacagtgaaaccaaagcagggcattgtattcctggcagatctgcgtgtggaaaatcgcgtttcacatgcatcacatttttactgggctcctgtcaagttctctctcctaggagaggaaactgagtttggtcggaccctactctgcaccccaccaatgctgtcccatttattcctcacactctaaagtcttagaaggacctgggtgtggagaaagcatgcagttaggattcaccaaccctcctgaccagctgtgaggcctgaggcaggtttctcaacctctctgagcttccattcccactccccagccctgaacacggagataatcataatttccctgcagggctgttgtaagaactaaatatggaatgccgtgggcacacagtgagttttgcacaaatgtcagacacgccttccgtggaggcacggaataccagaaatgtattgaaaagttcggaccctgatagcgaggttgcaattgacatggctatttcagaaagcgtggagcttgtcttggcaaaacgtacacaatttttgttgtgattaaaagcatgtggcaggatgctatcactttctacctatgagatccatgccacatccaggaaaagtggctttctgaataagatcttgatgctaggtcatcagcgcaaatctccacagcttcaggagagatcggatctggaccatacaagactcggggggccagaaagacagaggaggagataaccaactgactactcgaaagggtttttttttgctttttttttttttttttttccgagatggagtctcgctctttcgcccaagctggagtgcagtggtgctatctcggctcactgcaagctctgcctcccaggttcacgctattctcctgcctcagcctcccaagtagctgggactacgggtgcccaccaccgcgcccggctaattttttgtatttttagtagagatggggtttcaccgtgttagccaggatggtctcaatctcctgaccttgtgatccgcccacctgggcctcccaaaatgctgggattacaggcatgagccactgcgcccggccggttttttgttttttgttttttaaatgaagattcttcctttccttaaagctctgatggtttttaaatttaaattttaatttttttgagagttggtggcagctgccactcctcaaatcagtcatccagtcatccatcctctttcctggctaatctacattctgcccagatcacgctggtcaagaccagtattgagaagggagtacttcaagaacctttagatatctcactctttaatttctgtgagcaataaaaaccagagaagaggagcacaattttacctagtactaacaatttgacgtaagatattgattttatttatagatattaattacttttaggttattctttcattgaatatttattcaaagcaccagtactttgaaatacaaagtgtttcaaaatcttctgctttgtaaattccgccgcacacatagctacagacactggattataactgtacctcttttattacattattgtttgtttttgtttttgttgtgaacataaaatttaccaccttacccatttttaagcgtacagttcaatgctggtaagcgatgttaggtatattcacactgttgtgaaacagatctctagaacttttccatcttgcacgtctgaaatgctacaggcccactgaacaacagctcatttctcccttcccctataaatacatctcaagtgtgataaaatattttcccctataatatacacaaaaatcacagaaaagaatagtatctaaatcatacaataattaaataattaatcctacacactttacattccacttgtgtagtttctattctattcttttttttcctttttttttttttttttgagacagtctcactctgttaaccaggctggagtgcagtggtgcagtcacagctcactgcagccttgatctcctgggctcaagtgatcctcccacctcagcctcccaagtagctgggactacagatgtgtgccaccttgttgggttaattttatttatttattttttttttgtagagacagggtctcactatattgcccaggccggtctcgaactcctgggctccagtgatcctcccaccttggcctccggaagcactgggattatggacatgagccaccatgcctggctctgcttgtgtgttttgaggccaagctccctttttaagactgatgatgttttaaaggtcttttgattatttaagctgttacaaacgtacctaaaagctgtgttttgctcatgtctcctctctccctttgcacctctctcttcatcttctttaaggaatgaccatgatgttctcttccttctcccttttaggacctttgctcaagaagccataccagccaagaattaaaatctctaaaacatcaggtaaagcaaaggatgcggttgtgtgtggattgagagtaagagatgtttaaaaagtgtaaaaccaggccaggtgtactggctcacgcctgtaatcccagcactttgggaggccgaggtgggtgtattgcttgaggtcaggagttcaagaccagcctggccaacatggtgaaacctcgtctctactaaaaatacaaaaattagccaggcatggtggcaggggcctgtagttccagctactggggaggctgaggcaggagaatcacttgaacctgggaagttgaggttacagtgagccgagattgtgccaccacactctagcctggactacaagagtgaaactctgtctcaaaaaaaaaaaaaaaaaaaaaaagtgtaaaaccaagaattccttgaagccagttaaaaataccagctcattcagcaatgtatcaagcccacagtgtgaggcagagcctgagaagtgcagctgttatgaaaccatcccataaacaccatggagatagcacagtccccaggaagcctggcaggaaacccgatgaggctgcagtgagctatattgcaccacccaatagatgggtggcagaggcacattctgaccctcattgagtttagaagacatttgttttagagatccggagcatgcatccttccagcctctgctatcataaacataaaatggtgctaccaaaataaaaatgtctggtgtgacaggcaggctttgtttttgttttcatttttttcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagtagaaatggtgtggtatgtgcacatagaaactctcagaaaactgtcagatgagctagacagttgtcctctatctccatgggtcccgcatcccaaggatcgaaccaacaacagatcaaaaatacgtgaaaaaggaattgcatctgtattgaatgtgtacggactttttttcttgtctttgttccttaaacaatgtagtgtaacaactatttacatcgcatctcctttgcattcattattataagtaaactagagatgatttaaagtgtatagaaaggctgcgtgcagtggctaatgtctgtaatcccagcactttgagaggccgaggcaggtggatcacctgaggtcaggagttcgagaccagcctggccaacgtggtgaaaccccatctctactaaaaatacaataattagctgggcatggtggtgcacgcctgtaatcccagctattcgggaggctgaggcaggagaatcgcttgaacccaggaggcagagattgcagtgaaccgagattgcaccattgcactccagcctgggtgacagagtgaacctccgtctcaaaaacaaaataaataaataagaataaattaaaaataaagtgtatggaaggctgtgcgaaggttgtatacagatactacactattgtatgtcatggacttgaggacgcgtggattttagtatccgcgggggtcctggaactaatcccccatggacaccaagagacaactgcgtgcatgcctgaaaaatgccagcaatgtggatgagaactttgatctcctctgggggtcagtttttccccatcagcaaaagaccagcaccttgaatttcttcatatgttgcaattttcagggaagttgaggcacttcccagggagagcagccagatcctctcaagggcccgtgtcagggatgctggggcagaaagggtttctcagcagtcaatgcagggatgttagtttgctgcagcttaaaaagagtggactctgcctggcccctgcctacaccgtgcacagcgtgcatgcagacatgtccatgtgcacagaaggcagaggggcatttgagaaacaagttgtaggccggtgtggtggctcacgcctgaaatcccagcactttgggaggctgaggtgggtggaatgcttgagcccaggagtttgagaccagcctgggcaacatagtgagaccctgtccctacaaaaaataaaaaattagcctggcatggtggcacgtgcctgtagtcccagctactcaggaggctgaggtgggaggaccgtttgagcccaggagtttgaggctgcagtgagctctgattgcaccactgtactccagcctggtcaacagagtgggaccctgtctcaaaaataaataaaataaacaaattgcacttggaatataaattagagagaaggtaaatctccaatctggtaagagaattgatatagattctcaagaaatcttctgtctgtataataaaaggcaaggctgttcacctttaacagaggtgaaaatgaggagaacagataagaactgtcagctgaactttgcggtctcatctgtggacagaaatttcagagcagtgaagtcggagtgacccaaaggaggggtttccgccagcaccctgactgtgcgcctggccgcctactcgcattttgcttcccttgcctctgcatctaagctgggcatggctctcagtgcctgcgtgcaggggtggcgtacagctgacgctgcgaatgagcctggggtagcccatggcttcctgggagaagaagcaccatagatctcccatcatagggaggaaagtcctctgcatctgtgccattaaaggagaaagcaaatagcaagggatgtccccctgggaaatggaagcatgggggctgagtaccagttgaaggtgtgtggggatctctctttccttctcctctcacctctcaaagcttagttgtctagactgagctgaggtgtgttgaaaggagcattatattggaatttagaagacctgaagtcaaatgtttactgcaaactcactgggtaattctggggagttgtttccctcccactcatcttcctcatctggaaattgaggacacctccttccagaatagttttcaggattcaataaaataattcatgagaaaatagagagtagcacctacacaaggaaggtactgaataagtgtctttctttttctctccgttttcttctgctctggcagtggatggtgatccccactttgttgtggatttccccctgagcagactcaccgtgtgcttcaacattgatgggcagcccggggacatcctcaggctggtctctgatcacagggactctggtaagttctaccttccgctgcagcatctgggcaaggaccaggtaggtactgcatccccctctgttcttcagatggatgtccagtgatccaagggccaccttacagacgctcagtgagtatcgtcagtggttaagggaagcgcactgcgctcctggacttatgcatccgactccctgctttatgacaagtgccgtgtgaccttgggcacatgccttgggagttgtttcccttgtaaaatggagataggaacactctcttggcctcacagagctaatataaaatggatcaaatgaaactggttatgaagttgttttttaaatgctgaagtgctttagaaatccgctatgtaggctgggcgcggtggctcatgcctgtaatcccagcactttgggaggccgaggcaggtggatcaccggaggtcaggagttcaagaccagcttggccaacatggtgaaaccccatctctactaaagttacaaaaaaattagcccggcatagtggtgggcacctgaaatcccagctactcgggaggctgaggcaggagaatcgcttgaacctgggaggcagaggttgcagtgagctgagatcatgccactgcactccagcctgggtgaaaagagcaagactctatctcaaaaaaaaaaaaaaaaaaaaaaagaaaaagaaaaaaagaaaagaaaaccacaatatattattgtgtattattgtcatagtgtctatccattcaaaagctgtgatgccggggaggccaaggttctaaactcatgtcagtttcttgatgacttacatgggatgtcacatgttaatccacagttctgtctgtgtgccgtgaacatgtatggacaaaggggctctgtggcccctgttggtctgtagagggcttgggtgaaagagattagcacagagaaagcttttcaagttcgatgcaggtaacaaaccatgtccagctctgtgaggacaagctttggagtgggcaccccggcacttcctcactgctgagaacgtgtcttggaatgttgggttgcacagggtcccccagcaggtgatatgtgtgatgcaattatgtagagtttgatcctggggttccttcaacacatgttttcttgtgggactttatagcctcagagccaaatctctactgtttcttatttcaaagggctcaggagcaagataggggcctaactgtatatgtccttggaaatacctcctattctgggagcagttcccatggtttctgtcttcagcgagatgtccgtggtgggaactcagcctgaaaatgcttagaactttgaggctggaagagcataggctcttctcatgctgggatttctcctctcccctgaccccttgccccagagaaggcccttttttccttgaatgtctaagaagttttattgggaagattactgggaagattgttctcaaagcagagaaaacaagagttaattatatagcaatcttttcttattgcaaattgctgctttgcctgagagcaaaacacatttaacatgcatcacctaattcagccccaaacatctcaagtgcaatcgccatctgtttgttattcagccagacagcacggaaccctggggcctggttcacaggccttgctcaagtccagaaaagccccagtgatgttcataatgatgaagaaaaaaaaggagttctatttcatagcagtttacaacttacacacatgctaccttctgggatcctcacaaaaattctgttaggttttccatctgtccatccattttacagataaggaaattgaggcagggtttttgtttttttgagatgtagtttcactctgttgcctaggctgcagtgaagtggcaccatctcagctcactgcaatctccacctcctgggtttaagtgattctcctgcctcagcttccccagaaactgggattacaggtttttttttgacttgtctaaggacaaacacctaagtggaagaacttgagtttttggacaaaaacaaaacaaaaaacaacaactaagtttacattctcccacactgctcagtggcatcataagatgtctgagcaaactattgcaaggacagaaaaccaaacaccgcatgttctcactcataggtgggaattgaacaatgagaacacttggacacagggtggggaacatcacataccagggcctgtcgtggggtcagggtaggggggcgggatagcatgaggagatatacctaatgtaaatgacgagttaatgggtgcagcacaccaacagggcacatgtatacatatgtaacaaacctgcacgttgggcacatgtactctaaaacctaaagtataataataataataataataataataataataataaaagatgtccgaattaggatcagcagcctctggtaggtacaaaatatgtatcagggtcatataagagttcttatcactacagccacactggaaggaaaccagacgaacatggtaagctgtgtgtagatgcacaaatacttagcttcatgcctccatctacgatatcttgacccaaaactacatcctctctcccctatcccaacatactggtcagacaacagtaaaaaatccgcacataactttacgcattccctcatttgttcactcacttggtgaccactgagtgacctctgtgtgtaagtcagacatgtttttggtactagagatacaaagataagcccaaaggaggagggaagttctaacttgatgcgttgggcagggatagattttcttttcttttcttcttcttcttcttcttcttcttcttcttcttcttcttcttcttcttcttcttcttcttcttcttcttcttcttcctcttcctcttcctcttcctcttcctcttcctcttcctcttcctcttcttcttcttctttcttctttcttctttcttctttcttcttcttcttcttcttcttctttttttttttttttttaatgagataggatctcactctgtagcccagggtagactgcagtggtgcaatcacagatcactgcagccttgaactcctggcctcaagggaactcctgggctcaagtgaactagctgggactacaggcttgcaccactatgctcagctaattgtttatttttagtagagatggggtctctgtgttgcccaggctggtcttgaactcctggactcaggcaatccacctgccctggccttctaagtgctgggattacaggtgtgagccaccactcctggtcagattttctaaccttcttcttttccccttggcctttgaggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtaggaagctgcgctctcctcacgctgggcatagagggcagagttacatttcccaagcaaagctgatattgccaacacctttcgtttgattgagaaattcaataggaatgtggttttcattatatatacagtccgcatatgtatgtatgtatgtgtgtgtgtacatatatatagtctatacatatatacatatacataatgtattatatactatacatatatatgtatatatgtattatatatagtctgtatgtatgcatatgtgtacatgcagactgcatatgtgtatatagtctctctatataaatacataatatatattatatatgcagtctgtatatgtatgtgtatatggtctgtatatgtatgtgtgtgtatatatatacagtctatacatatatacatatacataatgtattatatattataaatatacatgtatatatgtattatatataccgtctgtatgtatatatgtatacacagactgataagtatgtatatatacagtctatatatgcacacatatacataatatataatcagtctgtatatgtacatatgtatgtctgtgtgtatatatacacagtctatgtgtatatatgtatgtatactgtctatgtatgtgtgcatgatatgtgtgtatatatacatacatagtctgtgtatgtatatatatatgtataccatctttgtatgtgtgatgtgtgtgtgtatatatatatacagtctgtatgtatggtgtgtgtatatatgtacagtctgtgtatatgtgtatatgtatgtatacactctgtgtatatatgtatgtatgatgtgtgtgtatgtgtgtgtatatatatatatatagcctgtgtatgtatgtgtgtttatatatacagtctgtatgtatgtatggtgtgtgtatatatacacagtctgtatatgtatgtgtgtgtgtgtgtgtatatatatatatacagtctatgtgtgtatatatgtatatatatatacagtctatgtatgtatatatgtatatatgtaggtatacagtctatatgtatgaacgtgtgtgtatatgtatatgtatgtatacagtctgtgtatgtatggtgtgtgtatatatatatatatacacacacagtctgtatatgtatgtatgtgtgtgtgtatacatatacagtctgtgtatgtatgtatatatgtatgtatgtatacagtctatggtgtgtgtgtgtatatatacacacagtctgtatatatgtgtgtgtgtacacatacacagtctgtgtatgtatgtacatattatatatattcacacccaccgacacacacagtcatgccttgcttaatgacagggatacattctaatggtcgttaggtgatttggtcattacgtgaccatctagaatatccttacacaaacctctctagatagtgtcgcatactacccactcagctaggctatgtggtgtctcctattgctcccgggctgcaaacctgtacagcatgtgactgcatggactactgcaggcaattgcaacacgatgataagtatttgttcatctaaacatatctagacatagaaaaggtacactaaaaatatgctattataatcttatgggaccaccatcatattttcagtccatcattgattaaaatgtcatgatgtggtgcatgactatatatgtaacatgaaaattacatatgtaatatgaaaattcgattactatatatgtaatatgaacattagattactacatatgtaatatgaaaattagattccttcctgggctttgtgagctaggaatgggctttataaaccagtagttctctttagccttctggaaaaatgaatgaggaattaaaatgtagtcacctgagggtccagttcctttgctctcagcaagaatacacagacacgaggcagccctgcccagcgcccagcctgagcgacacccccaccgggggggcacccacgtggccgtgcccagcaggcgggccattctacccagctttcttcaacgtgtaatttcatgtgggccccttgcccaaaaataaagagcaagccattgtcagggttcagtttagtaggcaggatttcctggctcttgagctggccgcgtttcgtggggcctggcggcccagcatgagctccccttgcagacacagctctttattcctgtggcctgagcagtgctgccatctgaccaggagagtcctgaggacgagggtcagagaggatctgagctgactgctttccacccccacccggcacagacctgagacggatagaaaggaggcgggcctgtgactgggaagaggacagagagaagatggaacactacttccctcttcatatgccccgtcctgtcctctggactcagtaggagaccgtggttatcactatgtgtaggttacacaactttctagtgttagcagctgggaagcttccagcagtcatgggtaaatcccacaatgtggataaatcctcagctctctccaccctgccccccagagcacatgttcttccatgtcactgggagagtccagtctcgggctgtggccagttgtaagcctttctgccactgatagctctgaagttggagttcagcacgaggtttctgcatttgactgagacccgatgcttttccttgtcctcccaggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggacaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaatagaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagaggggacttccagagtcaatgaacgtcacccttcagcggacggataccgggagcgcttgggcgaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcatgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgttgctactttaagagctgagaaaaacattccaatgagctatccatagctaacttgcttgctcagaaaaacataagtaacaaagttgagctttcatttttaaaaattatattttactttagaaaaatatcaccttttttcttcctcttctttacgtgtagatcttttttttttttttcaaatggggtcagtacctgaaagcccgaaaccccataccaagcttatagttaggacctttgcatttgataaaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgacccccgacggccccatgctaggtgcaccatcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtgtcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattgggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcgtctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagct

SEQ ID NO: 38488 - DNA, 142803 bp, Homo sapiens
ggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggtagggccccaggccgccggcccgcccgccgccgtcgccgcctggccccacgcccggccggccgaggtcggcggcccggccccgcggcggcggcgggcggggaagagggcgcggacgggccgccgggcgcggaccgcgtggggagggagcgagccgaggccggcctcgccgcctcccccacccgggcggcgggcatcccgcgccggcagcccggggccggccggcctcacgctctccggagttgggcgagagggagagttgccgcctcggcagcctgcgccctccctcaggaccaggctcgaggaaggaacgtgctcccggaccccagccgacttgtcgccgcctctggcttgcaggaagcgtgcggccggccgctgccacccccgggaaggacggtgtgcccggcgccgagccccgcttctccacgccgcagggcagcgaccctccgccctcttgccgagccagggaccctttcctttcctctcccgtcttccctgccctccccgctggcggtccggggagtgccctcgcccagagggagttctctcggtctgcccccgagcccccgcgcccgcagccggagaggaagtcttctcgccccgtgcctctggtgctggagaaggaggcagcgtttccccgcacctttaaggggctccgctgtcttgcagggagtgaagggtagcacttttttacgttaccagactacagacgaggtctctgcatggggagatctgtcagaggagggcctttcagggatttgtcactttgtatgttggggctggggtggaagtactgctaagctaggggcttgggggtgggggggctcccagctcttctgtcagtgtttgcattgttactgtcattcacgaaaggggcagctggatatggcatcagcacttttcccgagcagtcgccccagtcactggtcgccctacaccaggcaggtgctggaactacctaacgaattaagtttaagctttgagcgagttgagttttctgtctccactgtctaaaagcattttagacttctttatgtgaaagtgtagggactttccctttaataaagtgcttgttagaatgcctgttttctgggattattttcaggagtcacatttctggtatgttaacaaagacagttctactgtgattcctcatagtcttcagtcatttggtattggcttgtcaataactagacctaacttctcgaggtgaatcggatcatgtttccttttgcaaagaattggcttggagagtgacatggcctgtgagaaagcaaagatttggaagaaaattcatttctctgaggttgctaaactagctcattaaatacatgtaccttactgaaatacatgactcactgaagattttctgtgttagggagacacaaaagaattgtgaggattggatttgcagctatagctaacaggtagctatagttttgcattaagcaaatatgacattttatggttaaagtggcttccattcatggtcctaaagtacttcataaacatttaatcttcctcagagcctgagaatgccagttaaattattcttgttcagcttatggggaaacatgtagagaagtggttttttttttcctctctagacggagtcttgctctgtcgcccaggctggagtgcaatggctcgatcttgactcattgcaacctccgcctcctgggttcaagcgattctcctgcttcagcctcctgagtagctgagattacaggcgcgcgccaccacgcccagctaattttttgtatttttagtagagacaggtttcaccatgttggccatgctggtctctaactcccgacttcgtgatcctcccgcctgggcctcccaaagtcctgggattaccggcgtgagccactgtgccaggccagaagttcaatgttttaaactttcgttgtagtttgcattggaatgtgggcaagtgattctggaggaatttctatagattcttgaacattctttggataatcttatatgacatagcttacacttggatttggaaagacttctttggtattctaagatgaattcgttaatccagctcaaaacattctgtgattattgttatttatcaacagtgaactaaagaggactattctctgaaaaattctaagtatattcttatttccctaaattctgagtgaaatcaataatgccatttttggtaatgtgcattgtcacagagaaccttaaaattaaggccagatatgtgacaatttttgggggagtcagtgtgggactttttaaacttgagtaataattgagggtagatttaaagcaattcaattgtaaaagcttattttgtattttaaaaataaatgaagtgcaactacagataagtaaacttcgactgggtttagtaacacctgtctttaatatttgtcagtgtacctacattgataacattgacctttggaaaaattggacttgtattgtgttatttctctagcatattagtcctaaaaaagtgtgagtaataggagatggagaggtgtttgtggattgtcattctgtggttcctacagcattcaagttgcgtccgtagaattaatgtgtttaattaccgacataaataagggtgaaaacacatttgctttagttatatagctatttcagaaaaaaagtgtgtgtacatatataaatattacatatatacacacacatatatcttctttttgtttatcccttgttatatgctagatccatttatagagagtaacaaattttttcttgccctcaaggaattttcagtttatttgaagtaagtaagaacttttagggcagcaaataaatatcaagtaagttgagatgtgcttttaggactactgaggagggtagaatcattttggggtaggatttgaattatgctttgaaggaagagtatttgaacaggtttggagcagggaggaaggaacattggattgggaaaccccacacagatacagaggcaggtaaatgtaaatagttcaatttaataagaatggaaggtacacaggggcatagttcatgagcctggagtagtaggctggtcctagagtacagatgcctatgaatgctaggcatcattgggactggacttactcagttgagagtgaggaccaatggaggtttcttagtaggggactaatatgatgcaaatagcattttaggaaatttaatctcataggatgattcattctcacttctttttttttttttttttttttttgagatggaatcttgctgtgttgcccagggtggagtgcaatggcacgatcttggctcactgcagcctccacctcctgggttcaagagatccctctgcctcagcctcctgagtagctgagactgcaggcccccgccaccatgcctggctaatttttgtatttttagtagagatggggtttcaccatattggccaggctggtcttgaactcctgacctcgtgatctgcctgcctcggcctcccaaagtgctgggattacaggcgtgagccaccacacccagcccattctcacttctttatgtgtgtgcagcaggtatcagcaaactaactgtggcccatactgcaaatgtagctgcagccctttttttttttttttggtaaggtccagtagctaagaatggttgttaatatttaatgggttgtttaaaaaacaaacaaaaacatgaaatgctgtagagactgtatttgacacacaaagtctgaaatatttactctttggctcttcatagaaaaaatttgccaaaccctagccagtgtaggttagtggttgtcaaagtttgatctctggaccagcaacataatctaaatgtagtctgttttctccagatttgctaccgctttcatcccattattttaggcccttatcatcttctgtcagaataattacaactgtctccgaattggacttccttctgccagtcctatccctttaaatccatcttctgtactgctgcctgaatagtatgttggccaaatcattcctttgatcatttcctcactgatctatcttgcctcttggttaaggtctaagtcccctcataacttgccatcttcctatctctatgaccgctttcccctaccccaacccagttttggttttaccctccttaagtgacatctaatagttgttcattgtttctttaaatacatcatgctgtttcttatcactgtgctcttgcacaaactggtccctctgttgaaatattctttgttgggataattcctactcctcttttgaagactcaagtgttaacacctccaagaaacctaccctggtgctttgcctccccaatgtggtttttgatgttacctgtatatgaggtaagccaggtaccatgtcttactcatttttttgtaccctaagtactcagcataggttttgtacatagtagatgctcaataagtatttaactgaatgttaaagtgcttggcatatagtaggcgtataattagcaagtgggaagtattggtagcatatatggacagggatacaaatgtttacattctgaagagcggtggggctgatatgagactgctgccattcaagtctctgatcatggtatagatgaagcatcttggtggtaggaagggattaccaatcctgttctgccagttagggatccagggagtgtaagatttttaaagtatgacatactttaaacaagttcagctagatgaattaagtacattcacataatgagtattcaactcaagaaacacatcagtactggaattcccaccaaatgcccctctccccattccatgttccttgtattttaagaacagaaaaattttgtctgttttccaattctttatcagtggaattatatagtatgtattctttgagcttcttttttttttttttttttggtgacagagtctctctgtcacccaggctagagtgccgtggctcgatcatagctcactgcagcctcaacttcctgggctcaagcagtcttcctccttcagcctccttaagtgttgggattataggtgtgagccactgcacctggctcctttgagcttttgctcggtgttacatttgtaagattaatacatgttgtattgtactttgttcattctgttgcgtgacaattccagtttattctgttgatggacatgtgggttttttagttttgctgctgtgaacacttttatacctttttttggtcaatgtatatgtgatttttgatggatatatgccttagggtggagtgattagatcatggtctatgcaaatggtaagtttttttttttttttgaaacggggtctaactgtgttgcccaggctggagtgcagtggtgcgatctcagctcactgcaacctctgcctcccgggttcaagcagttctcctgcctcagcatcccgagtagctgggattacaggtatgcaccaccacacccggataatttttgtatttttagtagagatggggtttcaccatgttgtccaggttggtcttgaactcctgacctcaggtgatttgtgcccctccctcagcctcccaaagtactgggattacaggtgtgagccactgtgcccggccccatgtgataagttttagtagattctgctaaagttttgcaaattggttttacaaatttacactcccaccagcagtgtgtaagagctccagttgcttctcatctttgctaacacttggtattgtcagtctttttatttttagttattctggaagggtgtgtagtgatattgtagtgtagttttaattcatattttcctgatacttaatgaagttgagcattttttcttgttagggaccccatgtttattggccattggatttctgcttttgtgaagtgtctgttaaatcttttgccctttttttctactgggctgtttatttttttcatattgacttctagttcttattctggctacatttctttgttaggtacatattgcatctatcttctgcccttttagaatcttggtgtgtcagtgaattaaagcttttatttatttatttacttatttatttatttgagacagggtcttgctctgttgcccaagttggatggcaatggtgtgatcacaactcactgcagcctctaactcttgggctcaagcgatccccctgcctcagcttcctgagtaggattataggcatgtactatcatgcctggctaagttttaaaattttttgtagagatggtgtctcactcttgttgaggctggtctcaaattcctggtctcaagctattctcctgtctcagcttcctgagtagctaactacagatgtgcgccatcatccttggctaattgttaaaattttttgtagagatggtgtctcactttgttgcccaggctggtctcaaactcctggtctcaagcagtcctcctgccttggcctcccaaagtgctgggattacaggcataagctatcatgcctggccaaattcttagttttaaagaagtccagtttatcagttggttagtgcttttgttgtttcccgtttatgaaatctctacctacctgaatgtcatgaagttaccctcctgtgcttttttctaagagctttctctttttatctttcatgtttagatctatacttcatttggttgatttgagcatatgtatgctgtgtttgtgaagtagcaggacattacattaaattttttttgttgaagtaaacatatattgaaaaagtatacaaatcaagtatataccttggtggatatgcacagatttcatataccctatgtaacaagtccctgtgttaagaaatagaacatttctttgctttttttcccttggcaaatagtggttatattattgatggtacatcttataatcacggctgtcatggaattgaggaaatatccaaagtctgataatttcaaagaacattcttgaagtatttctatgatatatatcttaaatgcagttttagtttttgttttcattaattctactatgtttctaaacaattgataaaattatatcagggttctatagctggaaaactacagcttaatttttttggcatgtactgtaagtttaggagtataaaatgtttgctggaagtttgattggattaaaaaaagatagagtgtcaaaataatacatcttggtgtgtgggaaattgaaaaactgaataataaaaatatttctctttggaaagactatataataaaatttagtttcgaagtgaattattttatgttactaaatactgttttctgtatgctgatttttctttgcatcccatcctattattttaccttgcagaaaggcaagaaggaaagaacatatttaacaggcaaactgttgatatgattgcctgattatttctagttttcagtttccttgtcctttcacatgcagtttccaagtcaaaatcatctccttcactgtctccatggttcgtgtcaactgcttttgagtttttgtccatttgaaagaagatgaaaatgacaaaaactttcattaagtatatttcataggtatattacgtatgtatgtatataatccctaatcttcaaaaggaccctccaaggtaggtattatctccatttatggatgtggaaacaatgacctaagttgagtaacttgtttaaggtataacaagtaagttgaagaaccagtctgactctaaaattagagtttggtattaggggcaggaaggtatgggaaaatatgctgcccgaaacactgaacttactttatcctacttcattttccccaaactgcagtatgaatatttaactcatatatgtatattatgtatatgtgtgtattatttaactcatacatgtatattatatatatatgtatattgtggcttatataaaggatttcctcatacatatgtatgtatatatgtatatgtatatatgtatatatgtgtatgtatatatgtatatgtatatgtatatatgtacatgtatatatgtgtatgtatatatacacgtatatatgtatatgtatatatacacatatacgtatatacgtatatacatgtgtgtgtgtgtgtgtatatatatatatatatatttttttttttttttttttttttttgagacagagtctcgctgtgttgcccaggctggagggcactggcgagatctcagctcactgcaagctctgcctcctggttcaagcgattcccctgcctcagcctcccaagtagctgggtctacaggcatgtgccaccacactcggctaattttttgtattttagtagagacggggtttcaccatgttggtcaggatggtcttgatctcctgaccttgtgatccaccctccttggcctcccaaggcgctgggattgcaggtgtgagccaccacgcctggccatatatttttaattgttacaataatcttatgattaggtatagggttggtaatgcaggcaagtctttatttctaccctcaccttgccattttatagatgagaaacgaagacttggaggaggctacgtcatctgagtcatattacttgtaaatagtagagttgggttttgaacccaggacttctggctaaagcttactgttaagaagaaaaactaagacttggaggaggcttgtatgagtcgtaactggtaaactgcagagctaagatttgaacccaggacttctggctgaagcctactgttctttccatttatagctatgccagagtgagaagttgaactatttggaatcagtaaacatctttttaattgtcaagtaatatcttacattaaaaaataataaacataactaaaaacgaatgcttagtataatataaatataatacatatataattacaaaataattggtatattttaattaggctagtcctaacatttgaattggacgtaataaaatttatggcacttctgccgggtgcgatggctcaagcctgtaatcccagcactttgggaggccgaggcgggcggatcacgaggtcaggagatcgagaccatcctggctaacacggtgaaaccccgtctctactaaaaatacaaaaaaattagccggccgtgatggcgggctcctgtagtcccagctacgcgggaggctgaggcaggagaatggcatgaacccgggaggcggcgcttgcagtgagccgagattgcgccactgcactcccgcctgggtgagagagcgagactcctgtctcaaaaaaaaaaaaaaaaaaaaaaatcaaaatttatggcacttctgaagaggctttatttaatattcagcaattcaatattgaacgaatcaatttctgctatgtgaaaggcactgctgatgggactaggtgtatagcaggggatgaaacagactaaaattcctggagtttacattttaattgcggggacagatgatggataaagtaaggaaaattgggtgcatgttctcaggacctcttgagggctatgtcatggaaaaaaaaaaaatatgtggtatgctagatagaggaaagtgctatggagagtaacaaagcacagctggtgcatagggaatgtttaaaggctcaggggtccaggctgcaatattaaatagcattgaaagggaagacttcggccaggtgcggtggctcacgcttgtaatccctgcactttgggaggccgaggagggcggatcacttgaggtcaggagtttgagaccagcctggccaacatgatgaaaccctgtctttactaaaaatacaaaaaattggccgggcacggtggctcacgcctgtaatcccagcactttgggaggccgaggcgggcggatcacgaggtcaggagatcgagaccatcctggctaacacggtgaaaccccgtctctactaaaaatacaaaaaattagctgggcgtggtggcaggttcctgtagtcccagctacttgggaggctgcggcgagaagagtggagtgaacccaggaggcggagcttgcagtgagctgagatcgcaccactgcactccagtctgggcaacaagagtgaaactccgtctcaaaaaaaaaaaaataagtaaaaaggaagacttcactgagatgtcatttgagtaaagacttgagctgggtgctgtggctcaggtctgtgatcccagcactttgggaggctgagatgggaggattgcttgaacccaggagttggagaccagcctggacaaaaaagtgagaccatcatctctacaaaaaataaaaaaattagctggatgtagtgatgtgctgatgtgtgcttgtggtcccagctacacaggaggctgaggcaggaggattgcctgagtccaggaggctgcagtgaaccatgtttcaccactacgctccagcctgggcgacagattgaggatttgtccaaaaaaaaaaaaaaaaaaaatgcctgatgcaggtgaaagaacaagccttgtattgtacattatctggggatagatgattttaggcagagggtacagcaaattcaaaggttctgaggctagagcaggcctggaatatttgaggaacacccagtaagcaaggtcattgcagctgaaatgaagtgaactggaacagagtagtatcatatgagttaagaggtggctggagactttttgagacagggtcttgctctgttgcccaggctagagtgcagtggtgcaatcatagctcattgaaaccttaacctcccgtgctcaagcgatcttgccacctcaatctcctgagtagctgggactacaggcaggcaccagcgtgcctggcaaatttttgtatttttggtagagatgggggggcgggtctcactatattgctcaggctggtcttaaacttgtggactgaagcaatcttcctatctcagcctcccagagtgctgggattacaggtatgagccactgtgcctagtctagaaaggacttttacttgagtcagatggtcattggaaggttttgggcagttgatggcatgatctaatgtagatttaatataattacttggctgctgtgatgagagtagttgaaggttggggagtggtgaaagcagtggcaagggcagaaccagggagaccagttaggaggaaaggagtaatccaactgtgagatgatagtggcttgaaatgagtagtaacagtggagatggtgagaagtgattggttgttgaatatattttgaagatagagctgagaggatttgctgacatacttgaagtatggagtgcgaaagaaagaaaggagtcatggttatctcttaaggtttatccctgagcattagcagtgatggagttgctattatactgagatagggaagatctaagaggaacaagtttggcgggggaaggttaggagctcaattttgttattttaagtttgagatgttcactgtacagtcaagtgtatgtatgagtctggagtttagggaagtggtctagactggagatttaaaagtggagattagcatcatatagatgattttttcttttttttttttttgagacggagtctcacattgtctcctgggctggagtgcaatggcatgatctctactcactgcaatgtccgcctcctgggttcaagtgattctcctgtctcagcctcccgagtagctgggattacaggcgcccaccaccatgcccagctgaatttttgtatttttggtagagatggggtttctctatgttggccaggttggtctcgaactcctgacctcatgatctgcccaccttgtcctcccaaagtgctgggattataggcgtgagccactgtgcccagccataaatgatttttaaagccaggtatctggatgaaattaccatgggaatgagaatagttagacaaaagaggttcagtgaccaagccttagaacattccaacatgaagaggttggggggatgagggagatcctataaggaatacagattaagcatctcatgaggaggagaatgagatgtcctgggaaccaagtaaagaaaatacttcaggccaggcttggtggctcatgcctgtaatcccagcactttgggaggccgaggtgggaggactgcttgagctcaggagttcaagaccagcaacttagtgagacccccgtctctacaaaaaataacaaaaattagccaggtgtggttggcacatgcctatctatagtcccatatactgtggaggctgaagtgggaggattgcttgtgcctgggaggttgaggctgcagtgagctgtgattatgccactgcactacttcagcttgagtgaccgagtgagattctgtctcaaaaaaaagctttaagttgaagacatctcagcataatttatgtagatttgcctgggcatttttctgtgaaacacatatgtgtaagtctggtctaagccattctcgtcttagccatttcctgtgttactgggagagcttcctactggttgcccagtttccattctgttctttacacagaggcaaagaaatctttttgaaaatgtagattcgataatatccttttcttaatctcccctcccccaattacataaccacattccaacttcttaccacaacttacaaggtcttacatactatgacctctgcttaactttctcattttatctaccatttttcctttcaccacattattccagccattctgggctccttgctgttccccaagtatgtcaagcttattcctgctttaggactttttcagatacttcataagattgactaattctgactgatggtcaaggaaaggaaatttgtattgattgcctgattttgttagtcacaggaggagagaaaggaagagatgttgaaaatggttcaacatctgtaaggaatacagattaagcattaagtttgagaccagcctggccaacatggtgaaaccccatctctactaaaaatataaaaattagctgggtgtggtggtttgtttctctgtatatagtgtgtctttctgaatatagtgcgtatattctctgagtatttgtttctctgaatatagtgtgtcttttcttcaggttgcttgacgatttcttattacattttactgctgttatcatgtacctttgaatagttttgagtttatcctgtttggggcttactatgattcttggatgtctgagttatagttttcagaaaatttggaagttttttgtctttattattacctcaagtatttttttcattgaggtccctgacctcaatgtgttctgggagacagtagtctctggagatgccttttgcagaaagggtttatggtcaaataagtttaggaactattacatctgtttttctcccttgagccctgacagctcacagtagacttgtggtgcattacaagatctgtcttggcgagtgttctatgttcagtcttggtgagtgttccatgttcttttgaaagtaatatgcgttctctgctgggcatagtagttcatgcctgtaatcctagcaattcgggagtctgaggcaggatgattgcttgagcccaggagttcgaggctgcattgagctatgattacacgaccacactccagcatgggtgacagagcacgaccttgactcctaaagagtatgtatgttttctgtagttatggggtggaatgctctataaatgttaattagattaagttggattattgtattggaatcttctgtattcctattgattttcttttcactatttctatgaattcttaagagcagtgttgaaatttccatctatagatggggatttgtcttattttttcttttagtttcctttttttttgagatagggtgtcactctgttgcccaggctggagtgcagtggcacgatctcagctcactacaacctccgcctgccaggttcaagtgattctcctgccttagcctccctcagctgggactacgggtgtgcaccaccacacccagctaatttttgtttttagtagagatggggtttcaccatgttgtccaggtttgtctcgaacttctgacctcaagtgatccgcccgccttggcctctcaaagtgctgggattacaggtgtgagccaccgtgccatgcctcttttagttttcttgattcattgtttctttctctctctctctctttctctctctctccccctctgtctctctctctccctctcctctccctctctctcccttcctccctccgaaagtgctaggattataggcatgagccaccatgcctggctgttttatgtatttttgattttatattatttggtgtgcatattgggatatatgttttcttgatgaattcactctatcgttacgcccttctttattgaaaggtagtttggtaggtattaagtttttggtgtgttgtagcactttataaattttgtattgtattttggcttagcatagcttctggaagtctatgatttttttatatttgtttctctgaatatagtgtgtcttttcttcaggtcgcttgacaatttcttacttattaccattttcctgctgttatcatgtacctttgaatagttttgaatttatcccttggggcttactgtgattcttagatgcctgggttatagttttcagaaaatttggaaatttttcatctttattattacctccttgaggattttttttttctctttttgtatttctgacactccagtcacatatatcttgcatagcttaatattctcccacagttcactgagaatgttccccccctttttttctgtttccttttgtataatttattttgctttgttctcaagttcagtgatcttctgcagtatctaattttgcttttaattccatgaatgaaacttttatatcaaatattataattttcatctctatattccatttgattgtcttattttctttttttgagatagaatctcactctattgcccaggctggagtgcagtggtgcaatcttggctcactgcaacctccacctcccaggttcaagcgatgtgcctgcctcagcctctcccgagtagctgggattacaggtgcccaccacctcacccggctaatttttgtatttttagtagagatgaggtttcaccatattggccaggctggtcctgaactcctgacctcaagtgattcacccgcctcggcctcccaaagtgctgggattacaggtgtgagccaccgtccctggccaattctcttattttcatatattcatgtcatttagatttttgggcatattgaatatttctacaatagctgtttttttaatctataatttctgggtctgggtatagtgaattatttttcttcctgtttattggtcatgtttgcctgcctgccttcctccctccctccctctctccctccctcccttcctcccttcctctctccctcttttcctccctccctcccttgctctacctccacccccaccgcaaggcacgagtgccttggcacaatcacagctcactgcagcctcgacctccagggctcaattgatcctcctgcctcagccttctgagtagctgggactacaggtgtgcaccaccatgcccggctaatttttgtatttttggtagagacaggtttttgccatgttgtccagtctggtttccaactcctgggctcaagtgatccgcctgccttggcctcccaaaggctgggattataggcatgagccactgtgcctggccgtatgtctattattattattattattattttttttttagacaaagtctggctctgtcacccaggttggagtgcagtggtgcaatctcggctcactgcaacctccacctcccaggttcaagtgatgtcttgtgcctcagcctcctgagtagccgggactgcagacacgcaccaccacgcctggctaatttttgtatttttagtagagatggggtttcaccatgttggccaggttggtcttgaactcccaacctcaggtgatcagcccacctccgtcttccaaagtgctgggattacaggtgtgagccaccacgcccgacctctctattaatttttattggatgccagacattgtgacttttatctcgagtatgatatttgtggtattcatttaagaagtattgaggtggccgggtgtggtggctgatgcctgtaattccagtactttgggagggcgaggtgggcagatcacctgaggttgggagttcgagaccagcctggccaacatggtgaaaccctgtcttgactaaaaatacaaaaattagccaggcgtggtggtgcacgcctgtaatcccagctgctcggggggctgaggcagaagaatcacttgaacctgggaggcagaggttgcagtgagccgagatcatgtcactgcactcaagcctgggcgacagagcaagactctgtctcaaaaaaaaaaaaaaaaaaaaaaaaaaaaagaaagtattgatgatatttctgtatttctggcagacagcaacagcattacttatggatcatttttatagttttctgacttgttttacaattttttaggataaaaaataggatagtttggccttggtggagttctatcattaaagctttactcttttggggcctgttctaaatctgccatataatcagtgaggtatctccactcagactggtgatagctccaatgattttggcccactgagttctagaaattgttctttccccagaagagtttctttggctttgtggagttttaccctgtgcgtgggcaggttgtggtattaaaccaaaaacctgagtgaacccctttgcagatttccagagttctttgttgtttagcttcctcttctccagaattctgatccggaaattctagccacctagccttctcaaacttcagtatggcaaattttagtgatcccacccaggtctgtgctcctcttcactgggcagtagtttataagttgtcttctggcagaattctgggtcatttaaaatctcattttgtttatttccttttccacagtcctgttgcccatgtagtctaatgtctgaaaaaataatgcaatgcatatttatatgttttgtctagtttttgtagttgtatatggatgtaggttgtttggacctgttacttcctcatgagtggaaatataattcatgccactatagttttaatgtgtatttttcttagtatgagtgaggttgagcatgttttcatatctttctttcttttttttgagacagggtcttactgtgttgcccaggctggaatgcggtggcacagtcatagctcgctgcagtctcaaattccttggctccagtgatcctcgtgcatctgcctcctgaatagctgggactagaggcatgtgccactatttgtagaaaaatcgaccctttttttcctgtgacattagttggaagcatttttttcccagtatcccatttgacttttgattttctgatgattttttttccatagttttcaaatatgtattttagttaattgtttcttccaattgcttatatttattatctttagtgttttttggacatatctgggtgttccccatttaattctctataaatgctccttattattttattaattcattttttttttaaatttgagacggagtctcactctgtcacccaggctggagtgcagtggcacgatctcggctcactgcaccctccatctcctgggttcgagtgattctcctgcctcagtctcccgagtagctgggattataggctcccgccaccacacccagctagtttttgtatttttggtagagatggggttttgccatgttggccaggctggtctcgaactcctgaactcaggtgatccacccacctcggcctcccaaagtgctgggattagaggtgtgaaccactgtgccccgcccattaattcacttttgacatttcagtcttttatccatttggaatgtattgtgatatgagatttgagatatgaacccacttttgtttattgccatgacacctcttatctctgtaaaggatcagatagtgaatattttaggctttgtgggccatatgatctgtgcctttgcagctagtcaactctgcccttgtattgtgaaagcagctatagttaatatgtaagtgaataactggctgtgcttcaataaaacttgatctataaaaaaatggtggtgaagcagatttggcctcccaattgtttcctcagccctgacctaggcttaagaattctgttggaaattatggagagcgactaatccatgtggaaagaaatatgcctttttatgttgactattaggaaaagtgacagaaataatttaagaatttttgttaagctgatattcttataaaatttggaaacttctcacaatttcagaatattcctctgagatgcaagcgaaggttgagctacttgtgactgaaggctcaagcaaaagacaacttttaagtataagggagttaataaaataactgctgattttacctggctattttcttattaattacttaataatattttgttttttctatagatgatggattcatttataggtttaaaaaaacatttccctcctgtgtcttagaaatcagattgaccagtgcttactcttctagtatgagcgtttagttgctgacagcactgttttgcctcagagccaataaaaagagtaagattttttgtttttctgagatcagagcaacttagaaattggaaatgtttgaattatggcttaatattggcttagaattattttacacttaattaaattaaattttaaattaaaaacttttgtatacattcctgtgtgtgttgtgttttttttttttttttgagtcggagttttgctcttgttgcccaggctggggtacaatggggcgatcttggctcactgcaacctccacctcccaggttcaagcgattctcctgccttagtctcccaagtagctgggattacaggcatgtgccaccacacccagctaattttgtatttttagtagagacggggtttctccgtgttggtcatgctggtctcgacctccagacctcagatgatcctcccacctcggctcccaaagtgctgggattacaggggtgagccaccgcgcccggcccattcctgtgttttaaaagtcaaaaatattgagaagtctcattcctgcattgtccttgtgtattccatgttccccttcccttataggtggttgcttttatcaatttcttatgtgtctgtctatccagtgattgtttatgcatatataaacacacgtgactataagtcatcattttctctttttcagcaagagctagcttgtatagttattttatatttggcctttttgtagttaacaaatttgatagttgaagatcttttcatattataacatagtcattattttgcttttgataccccccttttttgggtggctccttattctggtttttcagaggaagatatgacacattcattaaggtgattcaatatagtgcatatctaaataatatatcatttgttctcttgctagtctcagcgaaatgtcatttgctcttgtgttagtctcttgtcagtctcagaatctctttatagccttcaaaattattgatagccctaaagagtttttatttatgtgggttatgtatatcactagatatcaaatcagaaactaaaactgagaagctataaaagttacttacttttggctaggcgtggtcgctcatacctgtaatcctagcactttgggagctgagtgggcagatcacttgagctcaccagttcaagaccagcctgggcaacatggcgaaatttgtctctaccaaaaaaaaaaaaaaaaaagaaaaaaaatttagatggcttgagcctggtaggcagagtttgtagtgagctgagatcatgccactgcactcgagcctgggtgacagagccagaccttgtctcaaaaaaagaaaaaaccaaaaacaccccagacaccaaaaaccagccaaccaaccaaagttatttactgttaatttatttaaaaatagcaataataaacccattacatgctaacataaatgacatttttaatgaaaataactatctttcggaacaagaagagtatgagaagagtggcatttgttatagttttgcaaatatctttaatgtctagcttaatagaaaatagctggattctcatatctgctactgcattcagtgttgtgatatgttgttttgcttgaagcatatggagaaaatctggcctcacccagatgtaaatttggaagagggaggagtattttatttaattttttgagacaaagtcttgctctgtcgtccatgctggagtgcagtggcatgctcatggctcattgcaaccttgacctcctgggctcaagcgatccttcctactcactttcctagtagctgggactataggtgtataccaccatgcccggttaatttctgtattttttgtagagacagggtttcaccatgttgcccaagctggtcttgatctcctgggtacaagtgatcttgtctacttcggcctcccaaattgctgggattacaggtgtgagccaccacacccggccaaaattatttaatagactttccagatacttatggatagccatatttaacgctatactgaaactctacatgcggtagttccttttttaaaaaaaatcattttattgagatatagttgataagttacatatatttaatatatctatgaaagtcaacacaatcaagatgtaccttttgaaggtaatttcttaaagattaattgcagtgtagaatttgaaaccatctcagtaaagttttcatattgtgttttcattaagatctatgaatctagttggtttatcctccactttggttgtatcttttttccttgcaggaattttcaaacatcatgcattagtcagttggaaaatatttgtttattgagttacgcagatcttctaaatgtttacacatttcattatttgttgtcaaagaatcacacctgttaatatcgtcaccattctctttagaaaagtgtttttgacttgggaagttgttaagcccatagtggtagaaactatgttttgcaaaattcgaattttttcgaagcttaaatattgttggttactttccctgatgtgacaagcccactagtcattttctttctttctttctttttttttttttttgagacagagttttgctcttgttgcccaggctggagtgcaatggcgcgatcttggctcaccgcagcctttggctcggctcaccgcaacctctgcctcctgggttcaagcgattcccctgcctcagcctcctgagtagctgggattccaggcacataccaccatgcctggctaattttgtatttttggtagagacggggtttctccatgttggtcaggctggtctcaaactcccgaactcaggtgatctgcctgccttggcctctcaaagtgctgggattacaggcgtgagccaccatgcctggctgcccactattcattttcaaggaaataactttcagatacccaagagtaagtaactagttgttctttcaagagaaatggtggtctataaaaaagcacagttcagcttgcaactctcataagatgctttttcttgagacagccatctttctacccatttaagtgcacagaatattaagaagttgtatacttaagggcaaagatttaatgtgtaatatttgcagctatatcaaggacattcttaagtgaaactggctttaaaaaatttggtgagtgtttggtaatgaagaatgtagtgactactactgtagttcggtgctactgctaatgagacaacagcagttttatccaatgttactttttaaattttttttatttttttcgagacagagtcttgctttgtcgcccaggctggagtgcagtgccccatcttggctcactgcaacctctgcctcctgggttcaagggattctcccgcctcagcctcctgagtagctgggattacaggcgtgtgccaccacgcccagctaatttctgtattttcagtagagacggggttttaccatgttggcgagggtggtctcaaactcctgacctcaagtgatccgcctgcctcagcctcccgaagtgctgggattacaggcgtgagctaccatgcctggcccaatgttacttttgaaccttcagggaaaatcccaatacagtgaaagaaacaaataatattttagtattattctcaaagtggttttggtctggaggaccttctgaaaggtcctgcagacttctggtatgtagaaatccttacttctttcttggcagttgaaaaagaaaaaaagaaaccaagaactcttaccaacttaatcttggttatcaatcttaatctctctgtacatactgactcctccaagtccttcctactaacactctgcgcatactccttccattaattacagtggctcattttggcatgattctcaagaatcatgaagtaatttataaattacaggtgattttatttttcgtccttcacctcaaagtatggtgaaggatgattggaaacctactgaattagaattactgctagctgggaccctatctgctttttttaccatacactaaggtggttttaatatatagcagttagaaaactacagctttgaggccttaggaagaaaactagattgctcagaatagaggatgatatcatcattatcatttttgtatttattgctcaaagtggaaggtgacatcaccactataatctttgtattttcaacacccagagctatctggcacagggcaggagctggccaaatgcttcatgaatgattgaatgactaatatgactagattataatgttatttgtctgacaccaggtttccaaattgaatgatgacaaatttagccttacattgtgtattaaataatatttacaagtgtatgttttagaattttgaaaaatgtaaattggttaatatgactgtactagttaaaatcattaatgattttttaattgtacgtaagcttcttatttcagcccacatgatatggcctatgcctacctatccttcctagtcttttgtcattctccttgtttgttgtgttttaggattaacaaaacatttgttggtccaggcaaggtggctcacacctgtaataccagcagtgtggggggctgaggtgggaggattgaggccaggcctttgagaccagccaggacaacatagcgagaccccttttctagaaaaagtaaaaaattagccaggcattattgtacacacttgtagtcccagttgctggggaggctgaggtgggaggattacatgagcccagtaagtcaaggctgcagtcagctttgatcctgtcagtgctctctaacctgggtggcagagtgagaacacatctcaaacaaaaacagaaaacttcggccattgttttctccctaattgttgcaacatgctacactctttactttagggcccttgcatttgctgttctctcttccgagacattgctttccccagctcttttcttgacttttcttatccttcaaataacaatttagttgtcgcgtacttaaaggtgcctttcctgtttttttggaagtagtctgttttcctctactgcacatagaatagcagtgaagtaaatatttctgtttgtttcttttatagtgtttatcacaatttgaagttacttaagttgttacttactgtctgcctgtctcctttagaatatatgctccatgagaatgtagacctgcctgtcttgtttactgttctatcttcataatcagaaacagtcctggtacttaataggtattttgcaaaacttattaatatgtttataaataggtgaatgaatgagtgaaaaggatatatgaaagaaaattattttggttacacaataaataatgagtgaaggtaacagttatattattattattatttttttttgagacagtgtctcacactttcgctcaggctgcagtgcagtggcgcaacctcggctcactgcaagctccgccttccgggttcatgccattctcctgtctcagcctcccgactggctgggactacaagcccccgccaccacgcctggttaatttttttgtttgtattctgtctcagcctcccgactggctgggactacaggcccctgccaccacgcccggctaatttttttgtttgtatttttagtagagacggggtttcaccgtgttagccaggatggtctcgaccacctgacctcgtgatctgcctgcctcggcctcccaaagtgctgggattacagacgtgagccaccgcggctggccaacagttatatttaaatttaaaaacaataggcagtagtgagaagggaagaaagaatagaacagggagttccatctgtaactgactgtgaataatctattgagataactcacagacaagctatataagtatatatatttatatacttaatagagttgggatcttgccatgttgatcaggctggtcttgaactcctggcctcaagcagtcctcccatcttggcctcccaaagtgttgggattacaggtctgaaccactgtgcctggctgccaagccagctatatttattagtaaagattttgcataaataactttgttctgctagattattaagttaaacattacatgcatatgaggacttctggtgtataaaattgcttgtggaatatgacattttctattaataaatgagtaaatgtgattctaaacaattgttaaaagccatgtaaaggagagcaacactaattcttggtggaaaataagtatgtaggctgggtgtggtgtctcacgcctgtaatcccagcactttgggaggcccaggtggctggatcacttgaggtcaggagttcacgaccaacttggccaacatggtgaaaccctgtctgtactaaaaatacaaaaattagctgggcatggtggcgctcgcctgtaatcccagctactctggaggctgaggcaggagaaccacttgaacccaggaggtggaggttgcaatgagccaagattgcaccactgcactccagcctggtgacagagcgagactccatctcgataaataaataagtaaatgtgtaaatgaataagattaaaatccttgctgtttataattttctaagaatcattttgttatttattttaggtaaacactttcagcgtttatagattttattttagggacttgggaatacatatctcttattttcttaaaaaaccagtggggaccatgttttactgtgttgtaaaatagtgacactgtcaggatttagtgaggaatttggtgatatttgcctgctctttaaatgacctcagatttctgtactattcatgtttattattattttaatgaccttttagtttggaaagattttagatttactgaaaagttataaagatagtacagaatttctgtatattcctcaccgattttcccctactgttaacatcttacagtaacatcttactcttacatggtacatttattaaaactaaaaatagtagttggtcagtacaattaactccagattttatttgatttcaccagtttttacactaatgtcctttctttccttttttgctttttttttggtttgagacggagtctcgctctgtcgcccaggctggagtgcagcggcacaatcttggctcaccgcaagctctgtctcccgggttcacaccattctcctgcctcagcctcccgactggctgggactacaggtgcccgccaccacgcctcgctaatttttttgtttgtgtttttagtagagacggggtttcaccgtgttagccaggatggctcttgacctcgttatcgcccgccttggcctcccaaagtgctgagattacaggtgtgagccactgcgcacagcccactaatgtcctttctctgttctaggatcttatccaggttaccacatcgtgtttagtgagcctgtctttagtcttctctgatctgtgacaaattgttaatttttctttgtttttcatgaccaagacagttttgagacactgtcaggcattttgtgaaatgttccttcatttggatttgtctgatttttcctccccacccctcttaattagattggagttacgggttttggggatgaataccacagaggtataatgacctcatcatatattggggttacattaaattaatgttggtgaggttaactttgatcgtttggttaaggtagtaagtgtttgccaggtttgtctgttgtaaagttgctatcttccttttgccgtattctgttctttggatgtgagtcgctgaagtccaacccacactttggatgaggaaatatttgcatacattacttgagttcttctctaaggaagatttgtctctgcccctcccccactcaacttatttatatccgtatggactcatgtatatttattttgtactttggaaggtaatccaatcccacactattttgttgctcagaatttttcagccttagctattgggattatttttaggttggtacctgaatccttttggcatgttccattctttggacttttaagcactctcttgctttcttcaagatgcttcaagctcatcttatattttcctgccctgtgggtagaatgttctatttctccaaggagccttgctttcttttattgggaaatgatatttagaaacaaagatttggggccgggcgcggtggctcacgcctgtaatcccagcactttgggtggctgaggcaggcggatcacctgcggtcaggagttcaagaccagcctgaccaacatggagaaaccgtgtctctactaaaaatacaaaattagccgggtatggtggtgcatgcctgtaatcccagctactcaggaggctgaggcaggagaaccgcttgaacccggaaggcggatgtcgcagtgagccgagattgtgccaccctcactctggcctgggcaacaagagcgaaactctgtctcaaaaacaaaaaaaacaaaaaactaagatttgggcattgaatgtgttaatggctactgggtatcactgcttctaagtcctgtcaggggacagagacaggaaatatatttatttatagtagcatatgtacacacatatctctttctgtatctatccatttttatgtatattaagatttaaaaaaattttttttaggcagagtcttgctctgttgcccaggctggagtgcaatggcacgatcttggctcactacaacctctgcctcctgggttcaagcgattctcctgcctcagcctctcgagtagctgggactacaggcgcccatcaccacacccagctaatttttgtgggtttgtattttttttttttcttttttagtagagatggggtttcaccgtgctggcgaggctggtcttgaactcctggcatcaagtgatccacccacctcggcctcccaaagtgctgggattacaggcgtgagccactgcacctggcctatgtatattaaacttaacatgagtttgtactcatttctccaactctaatccagtaccacagggcttgttttactgttttccctgtacttatctgtaacttctctcctcaacattgagaaacctggctcccacccaccatctaccattcattttacctatttgttcaatgccagtatacatgaaaagcaggtgtagaactgttaacctatacctctgtttgaaacaaatttaccagctagagtataagtttttatacagcttttgtgcctttagcgttacaatttctaatcaaagcatcatttcccaaagttaagtaactttgggaagttcctgaacttcatacgtatctttttttttttttttttttgagacggagtcttgccctgttgcccaggctggagtgcagtggcgcgatcttgctcactgcaacctctgcctcctgggttcaaacgattctcctgccccagcctcccgagtagctgggattacaggcgttcacctccatgcccagctaatttttgcatttttagtagagacgggctttcaccacgttggtcaggctggtctcaaacttctgacctcgtgatctgcccgcctcggcctcccaaagtgctgggattacaggcatgagccaccgcgtctggccttttttttttttcgaagacagagtcttcctctgtcaccaggctgcagtgcagtggcatgatcttggctcactgtaacctccgcctcctgggttcaagcgattctcctgactcagcctcccgagtagctgggattacaggcacccaccaccaagcccagctaatttttgtatttttagtagagatggggtttcaccatgttggccaggatggtctcaatctcctgacctcatgatccacccaccttggtctctcaaagtgttgggattacaggcatgagccaccgcgcccggccagttgtatcttgtatttgtaatactgttagattcatttgtcaccatctacatttcatcctaggatatcctgacgtattggtaaatttttttgtttggttaacttgcatacattaaagttcattatttatgatttcagttatatgggtctgacaaatgcataaaagtctatttctttgaaaaaaatgtgtgtatgtatagataatttcttttaggtgtcattatgcctgtttgtagcagtctgttgctttccccctggttgttggttttcaaacaagatcctgtggttgggtgtttggaaaataaatttattggaattgagtgaagttaagtcttgaatttttgggaactttcttgggagtaaaatacatgagtttcccttgtattaactaaaatgttgattttgttaaggcaaataaatgcttttctcccttggttcttgtttgtggtttcatttgaagtttgaatataggattaataaatatcacaatgttttagaaaaattaggccaaatgtggcaaggaagaacatttgtttggtgattatttttaacatttggatacatggctttcatgccacaagtcagataatatattgtttaggttttaaggcagagagataggtttaagttaccttaagtagtggagatttattatgggaaggtaaatgacataaaagtcccaactgctgcataacaaggtgtcaggaagacagagagtggttgaggaaatgggcagtcattgaggaaaccagggagctctaactactttactctaactactcctgctgtggttctcaactagaggctgtagtaagaactgtctgtggggccctccttcagatctgttcagtcagtcagtcttctttagtaatggggattgtctgttttcttctaaaactctgtatatgattctgataaacacttcttctctactattttgacattaggttattcaaggtcagtttcttctgaattggtgtacgattgactatttaaactgtgtgagggagatgggaaagagttggacactgattagtttatctagtcaccacgtttaatttgtatagaactcttgctgctgagactaccgtattggctgctggctcttcctgatttagtcatctgttgctagatggaagggtcctgtgatattatgccttatattaccatgcttggtactacttgcctctgcatttggctgtggtcaacaagtaatgcagaagtgactagaagttactatagatatgggtttagaggtggcttttctgtgcaggtagaagttaaattgaaatcccaaacgccgtgacgttctcagtgggagagttttccttttagagggaatgtatggctgaaatacagtgaaaaatgttggagaaggaggctaaaactgtatcctatatcatcttatataggattggtaaaatagtttgtgttttattctaattatgataggaagccatgtgaaatgacagagttcaagtaatttgactcatgcatttaaaaatgttataatggagcaatcattgaatgaagaacaatgacttaaaaataaaaaaaatctaaaaattatatatttatttttatagacagggtctcattctgtcacctagttgctgcagtgcagtggtgtgatcgtagctcattgcagcctccaactcctgggttcaagcagtcctcctgtcttggccttccaagtagctgggaatgcaggtgtttgtcaccacgcccagctaattttaaaattttctgtagagttgggggtcttgctttattgtccaggctggtctccagctcatggcttcaagcaatccgcctgcctcatcccctcaaagtattgggattacagttgtgagtcaccatgcctggcaaaatattttaaaatttccttgctaatgtaactttggcatcaatataatttagtcattagtttccgttctttttaaatttaaaagtactgtttttagataactgagttaagacagtttttttctttcttttttttttttttaaattaagacagtttctgatttggacttggatatagtctatctatagtttgtccattatctgttatattaataaatggctagtttctacatatcagtcaataattatttactaattacatagtaacatttcacagggagttgaagtagaaaataagtacaaacgagcccctgctacagttcagaggagccaacactagaagttagcaatatctatctttaaattgtgatttttctgacaatcatcaactaaagcaatggcatggcattccagtaccatggtgtttttagcttgctttttgttttttaaaattcagactcacagttttttaatactttattttttatttttaaaaaattgggattaaaattacataacatttgccttattaaccatttttaaatgtatagttcaaggcattaagtacattgacattgtgctgtcaccactgctgtttatccatagcagattcacaaattttgatgattttctgaaaaacaggaattaaatatattttacttaatatatgtaattattaataagtgtgaaacctcatgtaaagatcagtttagtattagttaacttttagagacagcaaagaaaaataaaatgaacattagggatagctcttgcattaaatgttaggattcctatatgtgattattgttaatattttaatatcaagttatatagttaggcattgtgtccccacccaaatcttatcttgaattgtaatccccaggcgttgagggagagacctggtgggaggtgattggatcatgggtctggtttcctctctgctgttctcatcgtagtgagggatttctcacgagatctgatggttttataaatggcagtctcttctgggcttttctcttctctctcctgatgccatgtgaagaaggtccttgcttccccctcaccttctgccacctccccagccatgtggacctgtgagtcaattaaacctgttttctttataaattacccagtcttgagtggtatctttatagcagtgtgaaatacatcaagacttttttttggggggggatggataatcatttcatagaatggtaaaatctgggaaaatgtgattccataggcaaagtattgccttatgaaaaaaattttgagacatacctaatgtgtaaagatggccataatagaagtaaattattagatgttgcttgggaaaatatatttcaaaagaaaaaagatactgaataacaaggagacaaattaatggtatccagtgtttggggctttgctcaaaatgagaatatgcattttaggccaggcacggtggcttaagcctgcagccccagcactttggaaggccaaggtgagaggatcacttgaggccgggtatgggcaacacagcaagaccccatctctaccaaatattaaaaaactagccggtcatggtggcgtgtgcctgtagtcctagctactcgggaagccgaggtgggaggattgtgtaagctcagtgagctatgatgatcatgccactgcactccagcatgagtttctggattctctttaataattatagccaacattttttgaacctttactatatgccaggcatttgcacttgcatttctcttttattttattttttttgagacagagtcttgctgtcttgctcagggtggagtgcaatgacctgatctcgggctcattgcaacctcctcctcctgggttcaagtgattctcctgccatagccttctgagtagctgggattacaggtgcccaccaccacgcccagctaatttttgtatttttagtagagatggagtttgaccatgttggccaggctgatctcgaactcctgacctcaaatgatcctcccgccttgacttaccacagtgctgggattacaggtgtgagccaccgtgcctggctgcatttctcttttaatacagcggtcatatgaagaaactgaaccttgggttgttcaaagtcatgtagttggtgctggtttttcaaccagctgactctgcagttggagctcttaatcaccatgtcatattgtttgttttaataaagcataagttttaataaagcaatatcctagattattaaccatgtatgtttacttgaatataaaatattagaaaataatttaactcatactacatattttattttgtgaagtttcatagtgtaaaataaaagtaagggtatgctgggcatggtggctcatgcctgtaatcccatcattttgggaggctgaatcatttgaggtcaagagtttgagaccagcctggccaacatggtgaaatcccacctctaacaaaaaatgcagaaattagccaggcgtggtggtggcggtggcagtggtggcgcacacctgtagtcccagctacttgggaggctgaggcaggagaatcgcttgtacctaggaggcagaggttgtggtgagctgagatcgtgccactgtactccagcctgggtgacagagtgagaacctctctcaaaataaataaataaattaaataagtaaataaattaattaaaagcaagataattttaagaaaattctctaatgtgtaaaattaaagatgttgttttcctgcggtcatcattgtgacttaaggttaaagattttagccatgcatgttgcttaaactatacagtgcacatgattgaatgttactcttgtaaataatatttttcaagcatgagaagtcctaaaccttcagtggctccccattgactgtctgtctacacagaaaatgagcaaactgcttaacctaggttttaaaggggtcagctattctagctttccctttctcaactatgcaggtttttgtttcatgaactgaatttgtcatatccacttctatgcttttgttcatggcttctttctgtttgaaataccctgccgtcttctgcttctctatttctgctttctagtttatccctttttcttcccaacattttccttcttctgaactctaaatcctttattaggtgctgtatatatcctaccttgttttatttagttgtttacccaactagataggtcttttgatggaaacggctgttgctggtgcttttttgtagttagtgtcatatacacaaagatctcaataattgcttgctggtaaagaggataagccatatatgcagtctcagtaatgttgcttaattaacattttcattttgttcatcctgtctcataaatctcgtttataatctgaaaatatatactcttgcttgaaatattttggtgtttaatttcatcaggaaatgaaagactctctaaaagaaaaaaagctatatttgtattgattagcaaaaatagcaaaaaaattatgatcatagtaatatgtgaatttttagaaatgaatattctcttgacagttgagatatttaattatccttactttatattggttctgaaaatatattctttcttttttttttttgagacagtcttgctctgtcacccagactggagtccagtggtgtgatttcagctcactgcaacctctgcctcccaggttcaagtgattttcatgcctcagcctcctgagtagctgggattacaggcatgtgccaccatgcctggctaatttttgtattttttgtagagatggagtttcaccctgttggcctgcctggtttcgaactcctggcttcaagtcatctgccctcctcagccttccaaagtgctgggattacaggtgtgagccaccatgcctggctgaaaatatattctttatagttctgaattatactttctaagtttggaatgtacatggagaaagcatttaagtttagcttttttgtgctgttagtgtttttctacttccaactctatttaaaaattttaaactgtgagaatttgcttccccatttgatactttatcttttcctcatccattgttcagttgtggagtactaatctcaggggaaacatttattaaaagtaattgcaattaaattagctgggtatggtggtgcacatctggaatcccagctactcgggaggctgaggcagaagaatcacttgaatctgggagaggttacggtgagctgagattgtgccactgtattccagcctgggtgacagagtcagaatgtctcaaaaaagcaaagaaaagaaaaaggaaatttactatattaagagtcttagttggaattaaaatttcatattcataatttatgggccacttgaagagaaagtgatttgtatgtacagtccaactctggacattgtgggttcttttttaattgtctctatatttttaatatatgagtgtattttttagtaatttttaggaatgtgacttgttagcactaatgcttatttggacatcattttcagcatttttgatttttgccacatttaaatgtatcagagtttagactcctttcttagctcatcattaaagtgttctgcttcttaggaagaaatgaatctaggacactactgtctttttttctaggtacacactaatggatgtggaagctaagtgctgtactcttgagatctgggtggcacctcccatgtgtctaggagatagagaatgggttcaagaggagtatgggcttttacataactggtccccaaaagtcccaaaatgtttatatattgcctgctgactcctctgaccgtcacaaagatcaggagatgagaattttcttcaaactctagttttgtctaaaggagctttgtctcaggagaatgcataatttaggtatcatcctacttaccaaactggtgtgcatgtgtatttctttttaaataattcttttacattagttttactttccttttgcagactaagtaggaataaacgttatttatttatttgtttgtttttttgagatggagttttgttcttgtcacccaggctggagtgcagtggcacgatcttggctcactgcaacctctgcctcccagtttcaagcgattctcctgcctcagcctcccgagtagctgggattacaggtgcctgccaccacgtccagctgattttttgtatttttagtagagatggggtttcatcatgttggccaagctggtctcaaactcctgacctcaggtgatccacttgcctcggcctctcaaagtgcagggattacaggcatgagccactgcgccctgccaatttttttttaaattttcatggtattcctcttatggcttaagaaaataatcagcagagtaccccttagaactttcatgatttcactaccaatttttttttggtttgttttttggtctttttagagatgtattttcactcttgttgcccaggctgaagtgcaatggcgcaatcttggctcactgcaacctctgtgcctccccgcaaccctggcccccctgggttcaagtggttctcctgcctcagcctcccaagtagctgggactacaggtgcatacaaccatgcccggctaatttttgtgtttttagtagagacaggttttcaccatgttggccaggatggtctccatctgttgacctcgtgatccacctgcctcaaccccccagaatactgggattacaggcgtgagtcaccgtgcccggccgcaaatgttttaatttttacttagaagcaaatttgagtcattggaaaagtatataacaccttaaatattcattacataaaccatcttgtcagggataagtaccttggttttcttaaataagtatattttgaatgtaaaactgaaaatgtgattttccaaccagtatattatagtaattggcattaagtgttgcacatttaaattattaactgcaaatgatgtcataaattgatttaactttgttgattatcaggcaaaaacatggtgaataaaggaagtgcccctatttttgtattacagaggaagttagcatgttttgtgaatatccatgatattaaactgttacaaaagattggagggagggagggagggagcgagcgagaaacaattagcagtttctgctttaactaattttttatttttatcacacttatgaactcctataaaaagatttatctaaattgtcttttttctttgttgattttattgaggtgaaattcatataatacaaattagcaattataatgtgtgtatttcattgacatttaatacattcacaatgttgtgcaactaccacctgtatcaagtttcagaacatttttctaactccaaaagaaaacccctattaagcagtcactctccttttcctcctcttatcccccataaaccacaaatctgctttctgtttctatggatttacctattttggatattttacataaatgatatggtattgtatgtgacttcttgtgtctggcttctttcacttagcatggcactttcaaggttcattcacatagtagcatatatcagtacttcattcttttttatgactgaataatactttattgtatgtatataacacattttgtttttccatttatctgctgacggacatttcaaaagactgttccaccttttggcttttgtgaatagtgctgccatcagtatttgtgtacaagtatctctgtttaaatacctgcttttaattctttttttttttctcttcccgagacagagtcttgctctgtcactgagtctggagtgcagtggcatgatcttggctcactgcaacctccgtctcctgggttcaagcaattctcctgcctcagcctcccaagtagctgggattacaggcacccgccaccacacatggctaatttttgtatttttagtagagacggggtttcaccatgttggccaggctggtctcgaactcctgacctcaggtaatccacccacctcggcctcccaaagtgctgggattacaggcatgagccactgtgcccagcctgtttttaattcttttagatatatacctaagagtggaattggtgggtcagtggcaattctgtgttcaacatctttaggaactgacaaacttttccacagtgactgcaccattttagagtcctaccagcaatatatgaggattctagtctgtctcttagctgtcacttgccattttcccttttttaaaaatagccatcctagtaggtatgaagtggtagctcattgtggtttgatttacatttccatgatggctaaaaaggatgatcatcttttcatgtgcttattggtcattgtatttcttccttggagaaatgtctatttaagtcctatgcccattttaaaattgggttgtctcttttgttgttgagttgtaagagttctgtatatattctgggtattaatcctgtatgtgatttgcaagtatttcctcccattctgtaggttgtcttagctttttttttgagatggagtctcactctgttgcctaggctggagtgcagtagcacgatcttggctcactgcaacctccatctcctgggctcaagcaattctcctgtctcagcctcctgagtagctgggactacaggtgcacactactatgcctggctaattttggtatttttagtagagaaggggtttcaccatgttggccaggctggtctagaactcctgacctcaagtgatccacctgcctcggcctcccaaagtgctgggattatgggggtgagccactgcattcggcccatactattctcttatccttttctgtaaggtaattagtaatgtctttattaaattggcttttaagtagagcttttaattttttgttgttgttatatcatttcttaatttggtatgtttttgacacagccagctttgtttcacttgcttcagaaggtggggaattgaaaacgaatgagtaatacaacatccaaaagttactttgtactggattttctgtatatgagttcaaagaaaggttcatcagaccaccagaccatctctctgctacatcagttatagaaacatttgagagattattataaaaaaaggtatttcacatataattttgtgtagtgctgttcctagtctgcacctttctgaatcttgtagtataaggcgcttgatataattttatattattgaatcttccacatgcttggttttagttatatttcttttcttttcttttctttttttttgagacagagtctcgctctgacggccaggatggagtgcagtggcacgatcttggctcactgcaacctctgcctcctgggctcaagcaattttcctgcctcagcctcccgagcagctgggattataggtgtgtgccaccacgcctggctaagttttatatttttagtagagatggagtttcactatgttggccaggctggtcttgaactcctgacctcaggtaatcctcccacctcggcctcccaaaatgctgggattactggcgtgagccaccttgcccggccttagttgtatttctttaaattaggtttttgtgcctgtagttccagctactttgcaaggctgaggtggaaggtttttttgagcctaggagttctagttcagcctgggcaacacagcaagactctatctctaaaaataataataaaaaataaagggtttaggctgggcacggggactcatgcctataatcccagcactttgggaggccacaataggaggatctcttgagcccaggagtgcaagaccagcctgggctacaaaaaattaaaaacaaatcatctgggcatggtgatgcaagcctgtagtcctagctcgttgggaggctgagttgggaggatcacttgagcccaggaggtcgagactgcagtaagctatgattgcaccactgtacaacagcttgggcaacagagcaagactctttttcaaaaaaaaaggtttatgcttacatttttctgggtgactgtgcctatgttaggtttatgcctaagaaagagggcctacaatctttataatttaacagcaaacatatcctgcagatggtaagagatccatatgaatgcatcaatgagtaaattaaaacatctgaaaatgtaacaacagcaaaatattaaggtggcttttggagagagttaaactcttttggtctaatttgtaggtaattatatgaaatatctttgttttattttgagatggagtctcgctctgtcacccaggctggagtgcagtggtgtgatcttggctcactgcaacctccaccttctgggttcaagtgattttcctgtttcagcctcctacgtagctgggatttcaggtgcctgccaccatgtccagctaattggtctatttttagtagagacggggtttcaccacgttggccaggctggtctcaaactcctgacctcaagtgatccccccacctcggcctcccaaagtgccgggattacaggcgtgagccaccgtgccggctgaatatctttgaacctgcaatgttgttaaagtggtcagtggtattaataaaaagtgttttgtgtatgcatttgtgcttttttttttttgcttcatcctggtgggaatgatagtgcattttgcgtgtcaatgagaactatacagtttggttaaaaaaaagatgataacagatagtaaacctaagactcatcaggaagccaggttgtataacagtgtctaacatagaataggtgtttaataaatgtttgattcaataaaaaaccatgaaactgcttgagtagttggctaaaataaaaacgaggctgagatcaactaaattagaattatgtcctttaaacaagctacattttctaataccataataagattactgtagcaaacgtaaaattgtcgtgagatcacaggggcagaattgtccctctggagagagggctactgaaaattacgaaagagaggccaggcgcggtggctcattcctgtaatctcagcactttgggaggccgaggtggcggattgcttgaggtcaggagttcagaccagcctggccaacatggtgaaaccccatctctactaaaaatacaaaaattagcaaggtatgatggtgcatgcctgtaatcccagctactcaggaggctgagacaggagacttgcttgaacctgggatggggaggttacagtgaactgagatggcgccactgcactccagcctgggcaagagagcaagattctgtccccgtcccctgccaagaaaaaagagaaaagtgaacttgtgttatatttattacaaaagtaattcaggtaagttatagaaaatttagaaaataccgtggccaggcacagtggctcacgcctataatcccagcattttggggggccaaggtgggaggattgcttgagaccagactgggcaatatagtaagatcccttgtcttaaaaaaaaaaaaaagttagttgggtgtagtgatgcatccctgtagtcccaggtgcttgggaggctgaggtgggagggttgcttgtttccaggagtttgaggttacagtgattgtgccattgcactccagcctgggcaacagagagagcctgtcttaaacacacacacacacacacacacacacacacacacacacacacacacacccacacacacacccccagaaaagatttagaaagtatagataaatataaagctgaaataagtcacttgttatcctaatatcttttttaaacttttttctgtctataaaaatgagatcattatacacatatgtgtgatatatatgcgtatacacacacatatatgtatatatacgtgtatatatgtatatacacgtatatatatacacatgtgtatatatatacacgtaacatatatatgtataatgtgtatatatacacacatatcacacatgtatatatgtgtatatatattatgtataaagcaggatatatatatatatatagctttgtagcctgcttaaatcacttaccagtaagtctaacatgagacttggtgctgaaatattggagattaggaatcctgccagaaagtttcctgtgtatttaatatagtcttacttatcaaatggccagttggatatagtgactagattttcctgtgtatggaatagacattattgggaaaattggtttgtccatatcatttatttaaaatcacattattagtattaataatatatattatgcacatatggtagtctacttacctacttgtttggtattttaaacttcttagtttatcaaccatttttttaacttttactttaaaattaacaattttattataaatatgctgtaaactgcatcaggacttttaaagtattttctagtttatgagaagaaagagttaaaaatggaatggaagtgtcctctttagagaacatatttactatctaaaattctgtgatgtccatctatgatggacaacaatgacaaatttgaatgaaaacaaacaaatagacattgaattgtgaaacaaacggaacacttaatttatatgttaggaattttcgggaaagcatggagattggaatgcaaggatatggactgaagagtagttttgttgtcagggaaacaattgaaagaaaaggagacctcctttgtaattaatctgacacttcttgggggacttgtccttgtgcaatttggtcactaacagaacagaggctgcacattaattaactggactgtttgctaccaggaggtgtccataatactagaaatctactcatactattagtagtggcaaatagttcaggacttagggaattctgggtcgggttatcagcatgacagctcctgaacatagttctaccattccatggtggaagtgtttgcagtcagccccacttgggtgtagacatctttgggtcccttggtgttagttgaagccagaaggagctcagatctgcagatgcatcctattcccgtatttcccctacaaagcattttcatcattcctttttttatagatgaggaaactggctcagacagatgttcattggtttgagaacgctcccagaaattctgcttcagtctttctgggtcagcctttggagagtcttaatttttattaagcacagcagctaattctattctatttggctcttgacctacagattgagacacacaggactcctgacttttggttggccattgtgagtttttacttccatttttctttttctccagaaaaatgcttacccatcattgcgagttttgattcttattatctaagtatgttggtcagtctctcattcttccaaggcctcagatgactctccaagataatatttgaagatagaggttataataattgcacaataactactttctgtactttacataaacaatttttaaaaaatgcatgtctgtgtttagtggggaaaaaacctcccactaaacacaaacacacattttcaaaaatctattaagttttactaagaaattatacttttattaggccgggcatggtggctcatgccctgttgtcccagcacttttggaggccaagctggatggatcacttgagcccaggagtttgagaccagcttggacaatatcgtgaaaccttgtctctacaaaaaataattagccaggtgtgatggtgcatgcctgcagtccccagttacttggaaggctgacatgggaggattgcttgagcccggaggtcaaggctgcagtgagtcataattatgccactgcactccaggccaggtgacacagcaagaccctgtctcaaagaaaaaattatacttttattaaaaatagttactgactattggccgggcgcggtggctcacgcctgtaatcccagcactttgggaggctgaggcaggcggatcacgaggtcaggagatcgagacatcctggctaacatggtgaaaccccatctctactaaaaaatacaaaaaaattagccgggcgtggtggtgggcacctgtaatcccagctactcaggaggctgaggcaggagaatggtgtgaacccgggaggcggagcttgcagtgagccgagatggcgccgctgcactccagcctgggcaacaaagcgagactccgtctccaaaaaaaaaaaaaaaataaaatactgactattgactggtaaatgattgggacctattaatatttctcacacagcaatttttatttaatgaaattatgtcaataactacaaaacagtttagtatggattactatttctgtcctttatagaacaaagtcctgtattatcctatatttatacaaagcttttttaaattataaaaatacttggttattatagaaaaagtttgaacgtatagagatgacaaagtattcgtaatttgacatcccagaataatcactgaaagcatattggtgtacatcatttacaaatgtggcagtgtttactcaggttgttttcaacataaatacaatatttttccaaagattttattttatctccctttttatttttttcattttttttttttgagacagagtcttgctctgttacccaggctggagtgcagtggtgcgatctgggctcactgcaacctctgcttcagcggaagttcaagtgattttcctgcctcagccttccaagtagctgggactacaggtcgtgccaccatgcctggctaatttttgtatttttggtagaaagggggtttcctcatgttggccagcatggtcttgaactcctgacctcaggtgatccccctgccttggcctcccaaagggctaggattataggcgtgagccaccgcgcctggccagacctagttttaatggcaaatagttattaaagacagttcatacttactattcatctttcagaagaaaggtgtctgcttcaaactctaatgacagatcaccgaataaccagtagtggtaactgacactggctggtaagtgagaacttagtaaaattctgttcatcctaaaataagtctctatttaaacagtggaggtatacagagccatttttgtaatgtattatgtgggaatgaagggatggtagttggaaagaggcgctaactgcatttagacttgtgagaatttttgctagttttctcactttttgaatgaggagattgggccagttgagctcttgtttgtttagtactttaggaaagggtggaaagagttggcttttagcaaacatatgtttaatatgtgttattccatttaatgcttaaccactccatataaagtaagtgttttatcctcattttaaaaattttaattttattttattataagttctaaggtacatgtgtaggatgtgcaggtttgttgtaaacgtatgccatggtggtttgctgcacctgtcaacccatcacctcggtattaagcccggcatgcattagctatttttcctaatgctgtccctcccacaaccccctgacaggccacagtgtgtttgttcccctccctgtgtccatgtgttctcattgttcagctcctacttataagtgagaacatgcagtgtttggttttctgttcttgcattagtttgctgaggatgatggcttccaacttcatccatgtccctgcaaaggacatgatctcattcctttttatcctcatttttatagataaggaaactgaaacttaaaagagttttgtttaggtcacatacccaggtatttctggctttatcttcatttctttcccttatatttactttgttctcatttataatattctttccaactctaaaattgtggttctgtaacagtggaaagaacactgtaatgaaccctcatttaccccatttacaagattattatcctatggctgacttgtttcatctgtacccctttatagttgcctcccagcattagtttctcccaccacattactttgacacagaactcaccattccctccctctcttcctccctccgtccctccttccctccttcccttcttcccttcccttctcttcccttccttccctcccttttttccctccctttcttcccttcctttcctttctttcttttttttgatggagtttcgcccttgttgcccaggctggagtgcaatggtgcgatcctggctcactataacctctgcctctccggttcaagcgattctcctgcctcatcctcccaagtagctgggattataggcatgcaccaccactcccgactaattttgtatttttagtagagacagggtttcattatgttggccagactcgtctcaaattcctgacttcaagtgatccacccgcctcaacctcccaatgtgttgggattacaggggtgagccgctgcacccagcctcaccatatcatttcatctgcagacattccagtatatagctctaaaagaaacttgaacacctgtgaaaagaagggaatacaaataaaaaaagaaactattttgtaaaaatttaaaacataaccacaatactattatcactgtaaaaacaacagttccttcctgtctactcagtgatttttatttaattttaattttaatttttattatttatttatttatttgtttttttgagatggagtttcgctcctgttgcccaagctggagtgcaatggcggaatctcggctcaccgcaacctccgcctcccaggtgcaagtgattctcttgcttcagcctctggagtagctgggattacagccatgcgccaccacacctggctaatttttttttgtgtttttagtagagacggggtttctccatgttggtcaggctgatctcgaactcctgacctcaggtgatccacccgcctcggcctcccaaagttctggaattacaggcgtgagccaccgcacccggcctactcggtgatttttataatttctttttaaactgcttgagattcatgtaagaccccatacattttaattagttggtatgtctgttaagtctttaatctacacatttcacctctatctcactttctcgttttcttgcattaaaaaaaaaactgtgtttgtgtgtgtgtttgtgtacgtgtatgtgtatgtataaagaaactgggttttgactttcagacatcctcataccgtggaggctgcgatggtgttcaacgtttttctgtctcatgtattttatacaatttggtaatttgatttagagtattcctgtctaatataacgtaagccataaatttaagccatatataatttgaatttttccatatatacttttttaaaaagtgaaaagaaacgggtaaaattggtttgaataatacttttatttgacccagtatatccacaatgttattatttcaacatataatcaatgaaattaatgaagtatattgcattctttttttggtatgaatcttagaaatttggtgtgtattttatacttatagcacatctcagtattagccacatttcaagtacccagtagcagtatgtggctagtgactcctgtattgaacagcacagatttagagaactgatcagtcaggctttttgtttttatgtcaggaaatagagaatgcctgactctcttggtgtggtgctattggcagccattcatgaacattgtttttatctattgatttattagggcttgcaaagtggtgatattttatccttctaccttcatttattatctataatacttatctaaaggaatacttcccaaccttgactatttggtcacacccccgtcacctgccaaaaaaccctacacagttcatatagaaaaaggataaataatgcttgacctttttcttttatttaccagttttccaaataatgaatttgtttcctaccattgtccaaaagtaactggggaatattttgttttcacctgtcatagatattttagctttccttgcttcttggagtattagtcagtgtccttcagagaaacagaaccagtagggtatgtgtgtctacacctttataactatatttgtatctatatctatctgtatccctatctgtagatctgtttatcttcaatatagaaagagatttatttggaattgactcatgccattatggagggctgacaagtgccaagatgtgcagtcagcaagctggagacccaggagagctgacggtgcggtttcactttgagtctgaagccctaagaaatgggagagctaatggtgtagttagagactgaggatgggttggttgactcaagacttaggaagagccagtatttcagtttgaaggtgaaggcagaagaaatctgatgttgttgcttgaaggcttagtcaggaggaattagttctgtcttacttgggggagggtcaacctttttgttttaggcaggccttcaactgatgaggtggggcctacccacatagggaggataatctgctttacttagtctgctgattgaaatgttaatcttatctagaaatactctcacagatacatccagaaaaatgcttgaccaaatgtctgggcaccctctggtccagttaagtcaacacataaaattaactgtcacatccaggctcattttgtacatttcctgccctaaatattgttgtcagtcaatgaatgccctttgatgatacttttgatgatgaaaacactttgagattcatacttttcaaagctttacttttagtgttttttcatttggaaaggtgtaatttcttaaaagtgattacattatcttatacttaatttttagatgccttttctcacttttgggaaggaggtttttggtgtttactctgtcagtgtcatattgatgtttgtttctgataaagtacttgagagaagcatagaatgaaaacttacagcacagagtcatacctagtaaaatggatacacgtggtttatagttatctctctctctcttctttcttttcttttcttcttttttggcagagtctcactctggttactcaggctggagtgcagtggcatgatcttggctcactgcagcctcgacttccccaggctcaggtgattctcctacctcagccttctgaatagctgggattacaggtgcatgccaccacacccagccaagtttttgtgtttttagtagagatggggtttcaccactgtgttgcccaggctggtctcgacctcctggactcaatcctctcgccttggcctcccagaatggtgggattacaggtgtaaaccaccattcctggccattctttgtatcaacctgaacaattttacctcttagtataacaactgaattacagacgcaattgagtttatcctcttcatttttttttttacagaaaaggaaacagagggccagatctagttattgggaatgacttggtcttagagtcgtcagcatgctatagtgggagttcagagccagactaaaatggctcagattcttagcattgccatttactagtcatgtgaccttgaggaaacttgatttttttggtttatttataaactacagataataactatgtcataggattactgtgacagttaaccaggataactttttttttttttgagtcagggtctcactttgtcacccaggctgcagtatagtagcacgatcttgggtcactgcaccctctgcctcccaggcacaaatgatcctcccacctcagcttcctgagtagctggggctataggtgtgtgtaaccatgcctagctagttttttttttgtttttttttaaattttttatagagacagagtctcactgtgttgcccaggctggtcttgaaatccggagctcaagcaattcgcctgcctaggcctcccaaagtgctgggattataggcgtgagccaccatggctggcccaagataacatattttaaagaacccagtagtgtgcctgacacattgtaggtacactgtaaattctgtttttttcatgtcctcccagattgcagttttttctggcatattgttgcctctttttttttgatggagccttcctttatcacccaggctagagtgcaatggtgtgatctcgctcactacaacctctgcctcccaggttcaagcagttctcctgcctcagcctcctgagtagctgagattataggcacttgccgccacacccagctaatttttgtattttcagtagagagggggattccccatgttggccaggctggtctcgaactcctgacctcgagtgatctgtccgccttggcctcccaaagtgctgggatttacaggcgtgagtcactgcacctggcctcttgcctcctttttgaatttaacatcaagtatatctaaattagctgaaaataatatgctttgcttacatttgttactttgtttatagtatttgcttagcaaacttttttccttaatagactaaaaaaatttggtccttttctgaatttttctggatgacagttactgaaatttaaattgagaagatttggccaggcctggtggctcacacctgtaatcctagcactttggtaggctgaggcgggcggatcacttgaggtcaggagctcaagagcagtctgaccaacatggggaaacactctctctactaaaaatacaaaaattagccgggtatggtggtgggtgcctgtaatcccagctacttgggtggctgaggcacaagaattgcttgaaccccggaagtggaggttgcagtgagccaagatcacaccactgcactccagcctgggtaatagagtgagactctaaataaataaataaatagagaagattttacttttcatattgaagtactttatccaaagtaacttttgttattatatcttaatttattgtaattattgaatattagttacaaatagttcttaatcatattttgtgtgttagcagggtacagtgtaattattttcatgcttgtgttttgctacagtaaacaggatagtttagaaaggctataattaatagatgttcaaaagttgctttgatgtccttagataaaagctatgcttccaacaccaaatgctagtatttttaattatcattctcctttttaatttgaaataatggcttgagtactgtagtgctagctccaggattcttagcctgtattgtttaatgtgaatgtgcagaaaacattttagaattttttttttttttttgagagaggatcttgctctatcacccaggctgcagtgcagtggcgtgatatcgactcactgcaacttctgcctcctaggtccaagcagttctcatgcctcagcctcccatgtagctgggactataggcatgcgccgccacacccggctgatttttgtacttttagccaggctggtcttgaactcctggcctcaagtgatccgccctcctgggactcccaaagtgctgggattgtaggcatgaaccaccacaccaggccagaaatgattaacatttatctttcaaaaaatgcacttttagattcaggttgtttgctatttgagtgcagttgcagaagcatgttgtcagatacttgaatactgactttcccgtgacattaatagatagctttctttgttgtgaggtataaaaaatacaattgctgatgcccaaggttgtgtttcataaggtaaatgaattttatttgaggttctgtagacttcaaattgggagatcctcgaggtgatgaaataggaagtttaactaccttcatttttttttggagtagttttcatttgctttctccattttcttgtacctcatcttgtctgtaactacttgtaaatgcaacttttacctgcaacccctgaaaaataactgctcaaaggctcccaatttctcataatcaccaaaatcaattgattggctttttttttttcagttctcattgtgcttattcattagagagagttggattctgttaatcttcatgaaagatctcatctctttgctttccttgtactgtatcttctctttatctcttgagctgcacctcttttcccttccttattggcccaacttcttacttctctgcccaagtacctgtatctcaggactcactttttctaacatttctattgtcatcatcatcagtcagtccacgttcagatggctcttatgcattcttttgtctttaccaccttaattaaatgattctgaaatctcttgatcccttttcctgcacttaaggctcacactcttactaatgggaatattcagctggttgccttgttgtctcctataacttttggtgtgtccaaaatcaaagtcttcatcttagaacaaacttcatggctttccttgatcttgttattggtactggtattattattcatctaggcccattttaataatcattgattctttctcttatcccccttcaatttatttaggcacacagttctagtctaactttgtttaacacagtttgggctgggcacgtggctcatgcctgtaatcccagcactttgtgaggctgaggcagatggattgcttgagcccaggagttttagaccagcttggtcaacatggtgaaaccccatctttactaaaaataaaaaattaaccaggcgtagtgtcgcatacctgtggtcccagctactcaggaggctgaggtagaaggatggcttgagccagggaagcggaggttgcactcagctgagatcgtgccattgcattccggccagggtgatagagccagagcttgtctcaaaacaaaatgaaacaaaacaaaacaaaacaaaacaccacacacagtttggaggatggtggcttttacaaaattgaggttagttgatgggttattagttcatttgctgattcggcctaagagcaggaagaggttcttatttcttaaatagaagttttgtggggactgtggttgaaaagaaggtgccatggcattgtagaatccttttaaagttgctggtgcttgggcatgactgaggctctgaccttttctgttatgatttcctgttagttggagaggtaccacttcaatccaggcaccttttttacattaacacgtctgcttcagcgtcaggcagttcattccaaagggaatgaactggaaatcatatcagaaaaggtcagagcctcagtcatgctcaagcaccaacaactttaaaagcaaagtgtttggcagagtggatacacacatacaactcaacttttatggactgtgcccttcatttccaaacttagttttccccctaatttatcaatatcagaaccctctggaaagtcttttattgtgatgggtgttatatctgattacctttttttattcccctgcacatctgaaacctggcatgcccatttcccatcactcagtccacagtagacatgtttcttggccagttataagggcagaggttgctgggattcttttttgtgcatcttatggttgctaaatcagaaactttttagatggatgagctggcacttgcagtactagtgcttagtgaaagaaggaaacagacctcaacatgccacaacaaatacccaaaaccaaaaattgtatcccattatagttaattacttcagaaggcaatttaacttatctagattatctgtaaatgctgacgaagtcagagtggagaatagctcaagcccttgctagacaaataaaactgttgtaactgttaattttgttcattagagaagaattatgaagaaagatattaataaggtgtttcatgtcttgactgttctctagatggttcttttctagagtatttccatgttctctgcttctttctaccagatatttggtgatggatatcatacttaggaaagtaaagtaaaaggaggaagttcctttttgctaatagggaaacttggtcacattggcccacatatatctaattactgtaatctatatgttatttgttaaatagcaattcttaaaagtttggttttatgcattttaacctagattgttaatgtagctattatcttaggttcaacaatgatttgtttttagccaggtttagcattcagaggcctttttccacatcagtagacatatcccacagcatcattgtttatgacttcatagtattctgttatatgattgcaccatattttttattacttaattttttgatagataatacatgtacgtagtgtaaaatacaaacgatctgaaagagtatacagtgaaaagcaaagtgtctctctttgttcccttttcaggatgcagtaactgttacacatttctttttttttttttttttgagacggagtttcgctttcgttgaccaggctggagtgcaatggcacgatttcatttcaccgcaatctccacctccctggttcaagtgattctcctgcttcagcctcccgagtagctgggactacaggcacatgctaccacacccagttaatttttgtatttttagtggagatggggcttcaccatgttggccaggatggtctccatctcctgaccttgtgatctgcctgcctcggcctcccaaagtgctgggattagaggcgtgagccactgtgtctggcctacacatttcttttgttcctccagagatattctacataaatacaaaccaatacataatcatgtatgatatatatgcacacacaaaaatggcaacgtattgtaccttctgttgtgtataatgcgtgttcttccccctcaattaaaagatgttccatagaggttcataaaattttgcttcattgttttccggttgcttaatattctggtttatgagtctgccataatttatttaactagtttatttttgactattcaattttcagattgtttgttctgtcagttcacccatgtgcaatcattacagcctctcttaccacattttacatggtgtcatcctctgggcttgatctgcttctcctgatcaaactgtgagtgaaagctcttacagaaggaaatcagtatcacactgaatagggtgagacagtgcttaatgtttacaaatctgttttgtggtagaaatatatgaaaaataaaaattctaacttttcattttctcttaagaaactcctttttttttttttcaaagaaattgcataagaagtgctaccttgtgtgggaagtgttatcctagtcctgattctttccagtcaggcagacttactttatttttccacagattatgtttttgttttaggatttgagtactgaattatcctgattactactactgactaattgtaaactccaaaaaatgaagaaaaaagaaatatgctagctgaatttggaaggaaataatcatttctgtttagctctgttttagggaagtactgtcgactcaacttcaagcatttgtgtcacttgaggtggttgctttttatggtccagatttatatttccctcactagagtactggacccttttgtcagacggtaaacatggtgtttttgaagccttcatttaaattggaaataggagcatggaggaatattggggcgttttgaaataaacgtggatggccgagcatggtggctcacgcctgtactaccagcgctttgggaggctgaggctagtggatcacctgaggtcaggagtttgagacaagcctgaccaacatggtaaaaccctgtctttactgaaaatacaaaattagttgggcctagtggtgcatgcctataatctcagctactggggaggctgaggcaggagaatcacttgaaccctggaggtggaggttgcagtgagccgagatcgccccattgcactccagcctgggcaagaagagcaaaactctgtcacaaaaaaagaaaaaaaaagaaataaacatggatagttttcaattagactagaacattctcatgaatttttggactaaaacagaagattttaaaagataattttgagtttaagtatcacctagggtctaagagtctgagttttattttcttcccttatcagtgttatttggaaaagctggagaggaattaattgaagtgagtctaagaaacaagggggttacttaaggcttcaaagtagcttggaggtaaaattaatgtgtttatttattgctaatttatagattatatgatttctcaattacactgaaaaatctcaggtataaaccttccaggagtctgttagctgcattcactgagaatatagcatgtgcaaataaactcctttaaggcagtgggcctcacgtttgtttgtttgttttttgtttttttttttgagacagggtctcactgcagatttgacctcctggactcaagcgatcttcctgcctcagccctggagtagtactacaggcatgcgccaccacacccggctaatttttgtatttttttgtggagatggggtttcaccatgttgcccaggctggtcttgaactcctgagctcaagtgatcctccctctttggactttcaaagtactgggattacatgcatgagccactgcgcccagtctcacattttaacgtgcaatggagtttcctgcagaggttgttaaaaattcctggttgccattccagagattgtagtggcacatctctgggataaaacctagggatctttcttttttttttttttcaaaacagagtttcgctgttattgcccaggctggagtgcaatggcacgatcttggcttactgcaacctccgcctcctgggttcaagcaattctcctctctcagcctccctagtagttgagattacaagtatgcaccactatgcccagctaattttttatctttttagtagagacggagtttcaccatgttggtcaggctgattttgaactcctgacttcagatgatccgcctgcctcggcctcccaaagtgctgggattacatgagtgagccactgtgcctggctgggatctttcttaaataaacacattacgtgattctggtctgtagactactttttgactattataggagtaagaattatgatttttttaaaaaaattaatttttacaagaatagagacaaggtcttggtatgttaaacaggggtctcactatgttgaccaagctggtcacgaacttctggcttcaagtgatcctcccacctcggccttccaaaatgctgggattacaggcatgagccacaaagcctggccaagaattatgatttctaaaaggatgaaaaatcataccccattagttaaaaagatttaaaggcaggagcgtgtaaacattttcaggattgtgggtaatttaaaataacaccatagtgcagcacagtaagcttggtgttgaaattggtttgtcttgtgtgaagacagatagatactagttgttccctctgtgttagtgatggataacttgtggctggcaagaagactcaacaatcatgtggctatatgtgtcccaagtagcaaataagtatcttagaagtcaaaatacttttgtcttagaatttaagatggctttgattttaaaaaatcagaatatttaatttattttgaaataccaaatatcattgaggagtgggacattagattttaattttagcaaatgggagcatgggttaaatgagttaatttttcaaaatatttgaaggagagtagcgagattatggtgaagtaggccttgtcatgcatcattttgaatggatgcagttttggataacattttgaatatatgtatcaaaatcttataaaggggctgggcacggtggctcacacctgtaatcccagcactttgggatgccaaggtgggcggatcatttgaggtcaggagttcaagaccagcctgagcaacatgatgaaaccccatctctactaaaaatacaaaaaatgagctggacatggtggtgcacatctgtaatctcagctactcaggagactgaggcaggatagttgcttgaacccgggaggcggaggttgcagtgagccaagatcgtgcctctgcactccagcctgggtgacagagcgagactccgtctcaaaaaaagaaaaaaaaaaatcttatgaaagttcgtactgatttacatagtaagtccatttctgagaatctcaaaaggaaataattgtgtttttttttttttttttttgagacggagtttcactctatcacccaggctggagtgcaatggcatgatctcagcccactgcaacctctgcctcctgggttccagcgattctcccgcctcagcctcctgagtagctgggattacaggtgtgcgaccaccatgcccagtgaattttgtagtttcagtagagatggggtttcaccatgttggccaggttggtcttgaactcctgacctcatgatccgcccactttggcctcccaaagtgctgggattacaggtgtgagacaccgtgccggccagaaataatcttaaatatggaaaaagctttataagtatagatacataatacagaattgtttataataacacaaaaattggaaacaacccagtgattttatattaatgtttaaggaaacagtgatccattcacacaaggaaatattatttaatcatacagtgtctttgaagagtttataatacagggaaatgcttatattagaatgttatgtaaataaaagtaggctccagaattatatatcatcttaaagactagaaggaaatttggaaaatattaattttggcgattttttagtaattatgggattgtggttctcctcatacatattcctcaaattttctgtactgagcatgctttttttctaatgaaaaaatagcaagcaaaaataaatattttgatcttaaaaatagtttagataagatgctataatcagatattatcaaagtatttagtggcatttgacagagctaggaaactgatttataaacagtgaataggggtgggaagagagaatccaaattaatggactgttacaggaatcagtgctaaacccattttcagatgaggtgtttgtaaatgaactggaataagtatactgtgattctccaaatttgtagctcttttgggtacgaaatgccaatggaattggttttagctctgaaaattttgagactatatatgaacggacagaaaagtagtaagtgatttccagttggccaaatctaagaggtggttggtacacactaaagattatttattgggattgttaattgccctctgctattgtattctgaaatacagtatagccaaaaatgtaaataaatacttaaaatatttacataaattagtagatagtaaggaatccaagatatatggatttggcctaacctttgaggtttatataaaggcgaacagtcggtgtttttcacagtgcgatttttattttaattttaacttttaaaatttgttttgatttgatacagtactgctctggataggttttggatcagacttgctgtgacagttcttgcactccctaaggtgctgtaccaagggcatgctattttctgtgtgaggagccctatcagatacataaaaacaaacaacatcctttgagatatatctaaaaataggatatgaattttgtaaaaagcatagcaataaattccaagtgtgtgatcatagtagagcattagtaatgagagaaaggatttggaggaagctgctgaaatgttatttgtttttaaaatcaaatggggctgggcgtggtggctcacacctgtaaatcccagcactttgggatgctgaggtggttgggtcatgaagtcaaaagttcaagaccagcctggccaagatggtgaaacctcatctctactaaagtacaaaaattagccgggtgcggtggcaggcacctataatcccagctactcgggaggctgaggcaggagaatagcttgaacctgggaggtggaggttgcagtgagccgagatcgtgccactgcacttcagcctgggtgacagagtgagagtccgtctcaataaaaaataaaaagataaaaaaaaaaaaaaaccattaagtgagattttgtagttggtaaggcttctcggaaacacttttcattgtagtgagaagcagtggttcccaaatgctgatttttgatgaatttttcactgttctgcattgaaattaagaatatcagaacatcatagtgagtggggttttcatagtggtagtatatttcatgaattttaatatgtatgttttcccacactttttcatttctgaaattgagatgtgttttccagtcagtagcaacttaaaattatcatttggaaaatagttgtcactgcctgttcatatgtgaatttggtagttaatcctactgatatgactgactacacaacatcacccctttgatgtttcagtcaacatactagttaaataccaattacagaaggtgtaccatccctgggttgttttctgaaaccgtctgttacatcattcagtgataccttttggtaagatcaggaaagggactgcattgagacttgggcgatatatgtcagcagcttggaagacagtcccaaagcaacagagaaacactttaaaaaaatgttgaatcatgaattctcttaatggtatgaaggacgatactatggaaaaacaaggattgctgatgactctaagtaaaaagcaatttgatgatcagattgtgaatgttgaggaaaattttaagaataccttatttattttgcttttgtattttttataagcacaaggattatatatttgtctgaataagtatttttttgttttttaaattttttacttccattgttttatttttcttttctttttttttttttgagatggagtctcactgtgtcacccaggctggagtacagtgtcgttatctcagctcactgcaacctccgcttcccaggttcaagcgattctcgtgcctcagcctcccaaatctgggattacaggtgtgcgccaccatgcctggctagttttttcttgtgtttttagtagagatggggtttcaccatgttggccaggctggtctcaaattcctgacctcaagtgatctgcttgcctgggcatcctaaagtgctgggattacaggtgtgagccactgtgcccagccaaagaaataccttttaattgcttgttcattaataggtttttttttgttttttttttttgacggagtcttgctctgctgcccaggctggagttcagtgctgtgatctctgctcactgcaacctctgccttccaggttcaagagattctcctgcctcagcctcctgagtagctggaattacaggcacctgtcatcatgctcagctgctttttgtatttttggtagagacagggttttgccatgttggccaggctggtctcaaactcctgacctcaggtgatccatctgccgtggcttcccaaagtgttgggattacaggcgtgagccactgcgcccggcaataatatatgtctgaacaagtttaaaagaactctgccaataagtgtaaaatgacataattctaagcaatagaaaccatatgtcatagtttgagagaggtttttttccttcttagtgatacttaaaataatggtgcacccaaatattgatggtatctttttaatttttaatttttattttttgcgggtacatagcaggtatatatatttatgggaggtacatgagatgttttgatacaggcatgcaatatgaaataagcacattatggttctgctaatagttgcaagggaatggggtatccatcccctcaatcatttatcctttgagttacaaagaatccaatcatactctaaattattttaaaatgagcgattaagttactgactgtagctaacctattgtgctatcaaacagtaggtcctgttccttctttctggttttttttttttttttttttgtacccattaaccatctccacctcctatccaaccctccaatactcttcccagcctctggtaaccatccttctactatgtccatgagttccattgtttttttttagatcccacaaataaatgagaacatgcattgtttgtctttctggtgcctggcttatttcacttaacataatgatctccaattctatccatgttattgcagatgactggatctcattcttttttatggcttatgtgtatgtaccactgtttctttatccattcatctgttgatggacacttaggatgcatccaatcttagctattgtaaactgtgctgcaacaaccataggagtgcaggtatcccttcaatatagtgatttcctttcttttgggtaaatacccagcaggaaaattgctggatcctatggtagctcaattttcaattttttgaggagcctccaaactgttctccatagtggttgtactaatttagattcccaccaacagtgtataagggctcccttttttccatctctttgccagcatttgttaactgcctgtcttttgggtacaagccattttaactggggtgagatgatatctcattgtagttttgatttgcattctgtgatcatcggtgatgttgagcaccttttcatatgcctgtttgccattgtatatcttcttttgagaaatgtctattaagatttttgcccatttttgatacaattattagggtttttcctgtggagttgtttgagctccttgtgtattctggttattgatggcattttgaagttgatgaaatgtggttaatttattcagtttaaaggatttagattatctcaaaatcctgcctcagccttccaagtagctgggactacaggtgtgcaccactacgcctggctaaattttgtatttttagtagagacggggtttcggcacgttggccaagctgatctcaatctgctgacctcaaatgatctacccgctttggcctcccaaaatgctggtattacaagtgtgagccactgtgccctcttttgtaattttattggcctgtgaaaatcagagatccaggaaccgctgtttaaaacactctggcttattcatcttattatttatagatttctcacgatagatcagtttatttcttagtttgatttgaacatatttcacagaatgattaataatgaaatactgggtgccaacggcctacttttatttggctttttatgtgttgcttcttgttaccttatacccaaccatgtgggattgagtttattgtgctaataggcaggtattacctataaaaaaaatggaaaaagttgtggcagttggtcattctttaaattacatatgtagaatagtttcagcaacactagaaggctcccttgtggagaaatgtttctcttaccagcttgtcctggtatctaaaatagatcttttctttatctacaccttcattttatctctagaggaaactttgtatacatatggatttgcgaattccatgacaactgttgatctagacaggttgctggagtatagcctataggccagcaacattgctatcacctgagaagcatgttagaaatgcagaatctcagtcctactgtataactgtaggatcagaatcagcatttcaacaagattctcaggtgattcatactcactaaatttgaaaagagaacacatgacttttgtctagagtaaggaggagcaggctaaacagcgatagagaagtatagaaaaccaatttggcttagttcattagcttattttagaatgattctgttaatagttgcaagggaattcttgaaaagcaggtgtgtgtgtgtgtgcgtatttagtgtctggttttgtcaccatgcaaataaacttacttggaaaatattctttgagtcaagtgggatttaaatagaagtgttactgtatttcctacagctcattgtttattatctatttcttgaggagatacctcagcttaattctttgggaacctacttttactgttgtatccaaaaaagtaaatgcctatttatccctcttaagggcaagatcacacaaacattaagtagttttgctaggatttagcaatgctttttctttttccatttatcagtatttcttcaaacccagtggtatttgaaaatcaaagcacgtatttctaaatccttcatgtatcaaggataccatattggcaagtattggctagtctctgtgaaagaactcagattcacctttttacttgacactttatagataattaagcaatcatacgtaataaataggtatgcttaattatcttattcaaagataagtgagaaacttggagtttggctcttaccttagcgtccttgggaagaaattggtctttttacagaagtagccatatgaaagcttggtttactgcttaaaaacagtgaggttgttggcagtggggtggatgaattcaggtatattttctttgcttttatctgtttttcacattggttctgtaaacttcctgtgttgtgaacgtttttagggttatacagtcgtgttacttaatcacagggatgcactcgagaaatggtggttaggccatttcgttgttgtctgagcatcataagagtgtatttgccaacctagatggtatagcctactatacaccaaggctagatggtatagcctgttgttcctaggctacagacctatacagcatgttactgtatggaatactacaggcagttgtaacaaaatgatatttgtgtatgtaaacatagaaaagggaaaaggtagagtaaaaatacagtattgcagtttttcttttttttgcaatggagtctcactctcttcaggggcgtgatctctgcaacctctgcctcccgggctcaagtgattcctgtgcctcagcctcccaagtagctgggactgcaggcgtggcccaccatgcctggttaattttttgtatttttagtagagatggggtgtcaccatgttggccagggtggtcttgatctactgagctcaggtgatccacctgtgttggcctcccaaagtgctgggattacaggcatgagccaccgcgcctggcccggtgttgtcatcttattggatcactatggaatatgcagttcattgttgaccgaaacgtcattatgtgacacgtaacttatttttccttaagttaataatgaaattactttgtataagttttttggtaactgttcttaaattcaaattttaagatgaacaccattgtttaatcactgagtcagactttttttttgtactttgggaatttacaaatttactgtccattttaaacttgacctgtttatgtgtagcattataaatatatacagaaggacagtagatgcttaatttcagtgcatgttattgaaacacaaatacaaaataaaaacaaggaatatataccatttcatatccagattgacaaaaatgaaaaattctgacaatatcaaatattgggaacgacgtaggggaatgtgaacctttaactattacttgtgttagcaatgatgaaatgcaattaaaaccaaaatctgcttcccccagaaaacatctcttcaaaggtagaagaaaaaggaaacaatttcagtttttaataagtattaaaccagaatgacacgtgtatcacaagcaatctgctaaaagattgcaaagaccaaaagaatgctcacccttacatctagccaagtggatgtaacccattacatacatgttctcaagataaatagtaaatagtgttcaagtaagaggacttgataccatcatttgtcacacatagtttgtcctaaattcacttggtaattggagcaaccttgtgtgtgaacaaattggctttttctaaaggaaaaatgaactcatatctttatgacaggatgtaattttacaacttggaactagatggcctgccaaagttaggcaccctgtcctcccacagaaactgggagataagggtgccgtctctcttgatgatctcatttgaaagagatggttataaggttcttgagaaaggcagttttgggctgctggctagggttttacaaagatttacatacatctctaagcaggcagagaaagaatttaccaggttttgaaagaaaatcctctaagaaaagggggtcggggagtacaggtagaattaggcctcttattttaaattttaatttgcctgtatactgatggataagttgatccagctaccttagtgggcaagttagcaatgctgtagtcaagttgaagaagagtacaccctctgattcagcacttttacttttagagaaactgttaacatatgttcataggatacttgtagcattatgtattaatagtgaaacattggcaacaactaaagtatttgtaagtaggaaagtgaatagataaattttgctatattcgtatagtgcagtactatacagccctgcaaatgaatgatttagggcaacatatatcaacttgagtaattttcaaaacaatgttgaattactaaagcaagttgcagaaggttgtgtacagtatattgatacaacatttgaaaacatgcagaacaataccacttattgtttattgatacatatacagtgaaagtagaatagaatgataaacaccaaaatcaggaagtggttacctctaaggagggagatgtacaaagggatcagcaaggtattcatttatttcttaaccaaggaaaatcttaagtaaataaggtagaatgttaagatttaatttatttaggcagtgggtatgtgtgtgtttgttatattattacctagattcttttgtaatgtttaaatatttaatgattaaaagttttaaaagaaagaatggatggcaagcagtggaaggaaatgaggacaactcttcaagaaaatttgttgtaaaggggaccaaagaaatggaggggtagttgaagggaaattaatcagtgttagtatgacacatttgcatgctaataataatgataaagtaaaaaagggaagaattggtataggagacctataatagttatgggagcagaatccttgagaaagaaaaaaataatgggatccagtacagaaataccgtttggctcttgataggaacaaggacaatttgttgaaatacgagggaaagcagaataagtggtgggaagatgaagtagttatcttctcaatttagggtgaccaacatccaggtttgcttgtgatttagcagtttctcagaatgcagcacttccagtgctaaaactgggaaagtcttgggccaacttctgattgtttttccttgacaaaatgaaaagcattgatcattatcttctggaagtgataaggggatgaaggaagtattgaggcttaaggtgaaaagagaaggtatgagttaattctctatcttaaagataggagagcagattcactacgttaatgtgatgggatttctgagcattttaggggtctgctgaaatttatggttattattttaaagtttatatggttgtatttctctttagtctcattcagctattcaggtaaaagtactgagttaagtggaaagttggttttaaactatgttttgactgtgatggagggagagaggagcagaggagtgaggccacagcaaggaaatgactgtgatgatggatttttgagtctcagactaggtaagaagtagagacgaaggacagtggaaaaatttgtagggtctgttggagttaacaggtttctggtagtgaactggaaaaattagtatattgagtaaagaagctgagatgcttgaaactgagatttttaaggtagcgtagttactggttatcgatatttcattatgagaataggggactggagtgggatggaagaaaagatcattgggtgtggaagtgattaccttctgtggatgtcatttcagtgattaatctgtagagcagattttggtgctctataacatattcaattatttcctcttcatacactgagagtttctgcttcctgttttattttgtttaaatattgcctcaacttgtaaatcacattgtgttgctctgaaatgaagacagctgtaaataagtaaatcgataaaagcaaattttgtttagtcagaatttggccttatcatatggcttgttagagactgtgtagttggtaaattcaaacattaacatcccaactgatgatcctattgcgcattaagctagtttagtcccacataagttcagtgagggctttatgccacatatgtttatctgtagtacattgctttgctgactctaattttgtctttgtctttttataggaccgcagctgaatgcacagctagaaggttggctttcacaagtacagtctacaaaaagacctgctagagccattattgccccgtaagtcttttttgtttttgtttttgttttgttttttgagaaggagtctccctgtgtcgcccaggctgaagtacagtggcatggtctcggctcactgcaacctccgcctcccaggttcaagcgactctcctgcctcaacctcctgagcagttgggactacaggcgtgtgccaccacacctggccaatttttgtatttttagtagagacggagttttaccatgttggccaggctggtcttaaactgccgacctcaaatgatccacctgcctcggtctcgctcacgcctggcctgcactgtaagttttaagagtctacttaaaatcttttttgtatgtttattattagtaaatgagtatctacagattgaactaaaaattaaaaactgaagtctatactgagctgaagaaattgtattcagtaattttcacaattcttgtgggttttcactgtaacttaaggataaaagaattggctactttggctgcgtgtggtggctcacacctgtaattccagcactttgagaggccaacgtgggaggattgcttgagcccaggagtttgagaccagcctgggcaacatggtgagactccatctctactaaaaatacaaaaattagctgggtgtgatggtacgcttgtagtcccagctaagctactgggggtggcagtggtggggttctgacgtcgggggtcgcttaagcttgggaggtggaggttgtagtgagccagatcatgccactgcactccagcctgggtgacagtgaggccctatctcaaaaaaagaaaaaaaaagaattggctactttatttcctcagatagagtaatttcgaaatgtatttttgataataaaactgacttttaaagaaaagtgttttttacatcaggtaaacttgccaattttggtagccattgctataaatgaataagttctattttaaatattaaagagatctaatttaatcccgatgatttttaatttataatgaaaaagatatattaagcatagtatggtgcaacatggaatagcaacttaatttttgaggaggagtagattgtgtctttttttaattgagaaaatctgattattttgtctttggattttagagtttgctttttagaactgcaagctagcacatacacagttaatgatgtgtgtctgtgtatgatatgaattcagttaattttgatttggtttccagtgctaaccttcacaacatattgtttgaaacacatggtaacattttttctgagaagagtgaaggtttactctgtgccatttgtctcatagcatgttgttgtttgtgacttctattgggttaaggttcatgccctgataaatagtaaatagtgatgacaatatataataaccgtttttaatcaatatcagaattaaatgagcaaatagtaaatacacataaagagcctactattaatggtaggcattttatataccaaatattttgttaaatgccttatttgtatatctaacttgatctcatttaatgggtgcaggagcctgactcctacttacaagctatgtgacatgcaacttttttatctgttgggatttcagctcctcattggtaaagctggaataataatagtatttccttaacgcttttaacaaaagattaaatgaactaatctttataaaacttacagcaaatgacttactactatttatttagtcatttacataccaggctaaaggccaagtgctcttctttgtgctgcattttgagtaaatcaaagttgccactcttgtggtactagcattttggtactagggaagacaggcagtaaacaaataattatattctatgtcaggtgctgatgggtgctaagaagaaaaataaagcagatagaggattgagagtgacagtatgggtagggtgttactgttttatataggattagtaagaaaaggactccctggtaaggtaacattttagtctgaatgatgtgagagagcaagctgtgcagatagctgagggaagagggtttcaggttgaggaacagtgagcacaaaggctctggaacaagagtatgcttagtgtgtttgaggagaagcaaggaggccagtgcagctggagtggcagtacaaggggaagagtggtagatgagataggcagcggagggctagatcatgaagaggctttgtagtcataaggactttggtttttattctgagtgatatggcaagtcatgacaagttttgagcagtagaatgacatgatctgacttaggtttgaaaagaattactcttgctgctgtatggatattatattatgtgggaacagggagtccagtttaggaggcttattttacaattataattatagaaaagagatgacatagtggcttggattgggggcttgaggcagagatgatgagaagtagtgtattctggatatgttttaaaggttggaccaacaagatagagagaagaagagtcaagaatgacacttggctaggggcagtgactcacgcctgtaatcccagccctttgggaggcctaagcaggaggattgcttgaggccaggagtttgagatcagcatgggcaacaaaacaagactccatctctacaaaaattagctggatgtgatgggatgcaactgtagtcctagctacttggtagatggagggaggaggatcccttgagcccagggggaggctacagtgagctatggtctgtttgcaccactgtactcccgcttgggcaacagtgagataccctgtctttaaatatatttttaagacatggttttaaaatatcatgactgaatgattcttatgttttgtcctgtgaaactagaaggatggaattacctttatactgataaggggaagacaagtggaagtatggagtagattttgaagtgttcgtatagaatctaggtttttggttttgatcttgttaatgttgaggtgcttattagatatccaaatggagatttagaatgggcagctggctatatgaatctggagtacaaagaagaggcaccagacttgagatagaaataaaggctttattagtatatataatcacagagggtatggttgcctagggaataaaataaagataaacaggagaagagtttcaaggactagccccttggataagccacctttttagaggctagaataaagatgaacatttgcaaaggagataatgaagggagaataagtgaggaaggaggaaaatcaagagtgagtgatgtctctgagaggccaaaggatgaaaaatgtgtcgggggaaaaagtgatcagctgtatcaaatgctgccagtgaggactgaggattgataattggatttggcaatgtggaaatcactggtgaccttgagaagaaaagtttctgtggggtggtggaaatgaaagtattattggagtaggtttaggaaagaatgagaggtgagggcgatgaagacgtaagtatagatagttttttgaggaattttgctgtaaaacagagaaataggatagtatctatatggtaaggaggatttttatttcatttgtgagattttaaagtgtttgtatatgaagtgagtcagtaggggaagaaaaattgatgcagggataagaggggacatttacctaagagggatccttgattaggtgagaaacaatggattaataataatttctttatagtaactcacgagagacattctcatttcatcaatttgctggtatttgactattatggtatgctacctttccagttaaaacttgttctaaatttgggagctgagttgaatcaacatataattaagttgagtttagtattcataaaaaagtagccagacttgtttcctttttgtaattaattttaaattggaataattgggagtgacctgggaaatggaatgttttagcctaaattacaaatatgttgatttccaagttaccccagattttaaaatggatatttgaaaatagttttggctttggtgtgtttctgtgacatgctgactttgtatataacgtataataaatgttataataaacatataaacatataaaaacataaatataaacatacaataaacatatataaatgtgcattcataggcaatttctatttcgttaacataggaagactttataagtatagccaagttttatcttatatggtttccagaagtaattattttcctttccaaggctatcttttttttttttttgaggtagaaaacaaatctttcattgttactgggtgcagtggctcatgcttgtaatcccagcactttcggagcctgaggtgggaagatgcttgagctcaggagtttgagactagcctgtgcaacatggcgaaaccccctctacaaaaaatacaaaaattagctgggtgtggtggcatgagcctgcagccccagctactccagaagctgagatgagaggatcacttgagcccgggaggttggggctgcactgagctgagattgcaccactgcaccccagcctgggtaatgggagtgagaccctgtctcaaaaaaaaaaaaaaaaatattgttctatggcatgaaagggttatgctatttaataattagaaaaatcacattaatcaaaaacttactttaagttttataaatgttagctctctagtacttgcttttcttagtttttattttttatttttttattttgggacggagtctcactctgtcacccaggctggagtgcagtggcgcgatctcagctcactgcaagctccacctgccgggttcacgccattctcctgcctcagcctcccgagtagctgggactacagtcgcccaccaccatgcccagctaattttttttgcatttttagtagagacgtggtttcaccgtgttagccaggatggtctcgatctcctgacctcgtgatccgcctgcctcggcctcccaaagtgctgggattacaggtgtgagccactgcgcctggccttcttagttttttttttttacctttataggcataaatcatatcatggaaaccttaaataaactcagaacctggatatagttgtaactaattaggctgtgtgaaaatggcaagtttttgaaagtgcttaaaaatattgttcatttttatattgatatagattaaatagaataaataccattaaagaataaatattgacctgtcaactgttgttctatcttaatgaattctaatctgtgtgacataaggcaggcacgtttggaggatttaaaagaaattaatttgattagaaatgtactgtggttgaattcagaactaccttaccttgatgtgtaggagacagtatgtgtcgcagagatatatattgaaatgatctcatgagctaaaagtctgaaatgcctttctacatgacttccagatatcttcataccaatcttcttgcttgtcttgcactatgcagaaatatgtcagcaacccctagaatgaagctgtacagatatgcatcgcttaagaaacttattaaatataaaaatgtaatcaaataattggttaacatgaattttttttactataaaacaggtactttgaatattgaagccccccttatacatttaaaatacttgatattagttaacctagtaggactttgacttgatattagttaacctagtaggagtagtatgggagaaaggatacttccacttttcattgtgtaccctttattgtttgacttttttactgtgtgcatgtgttacttttaatataaaaattagtttaaaaaatgtaaatgctaaaaagcgtgtatatagaagacaagtttgtatatagtgaagcatacctgtacagtgctctaccactggatatcatgagacaatcttcatacattatttagttcttcaagttactgaggatgcacagcttatttgtctctaattattgtttgtactaagccataggatattcatgtcaaagtctcaaatcctatatgacagtacaaaaaatatctagatatgcaacattctggttagttcattcttatttgacttcaataactttaataactttccttagctcagactatttaatatttatgagattctattatgtaaaaataaaatattctgaataataactatctaacttggacttttttgggcacaattatctactgatattttttatcaaaacaggaatcttgagggccattgagcaatgcctacaaaataaaagaataaaagactaggtacagcaaaattaaattgagagaggcaatgtggaagctgctgcatttgcaaattatatagggccagttgtcaatcaaattgatcccatctgttcagaggagttttctaatttagtttctagctttttagatcttaccttagcttaagtagatcttgtgacttttcctattgttggaggagatcttcccatttcctctggttcagtcttctcatttcatctagttcaatctttttattttgcattttgctactattaagtagaactaggactattggacctgactttgttgaatcttagttaagtattcctttattattccctgtatcctctttgatgaaaagccttacatagaatgtgtggtagactcttggcattgacagtttatactgttcacctgtgaccctgaaggtctcagaatgaacaagtgaaaatccatgtcctgtagtaattggtcatttttctatggtaagaatttgaattatacccacattggaaggttgctgtgtgggaaactgtcacataaccagtaaatgttcatgagcaatgaatggcctttgcatcctcacttgattgcagttccacagggaaaaacagaaattctggtgtcaggaactagacttgccgacgtaaagggtctactgtgtaggagcaaagggagaagcaaaagcactccctgttaaaagaaggatcaatttttagaggcaaggttttagcttgataaaatgttgtaggtattaagtataattttgtgtttgccttcatgatatgttaggttgggaatcagagtgacttggaaaagttagtggggatggctttttgcattaaggactttaagagcttttaaaagactaagtgggacaggccaggcgcggtggctcatgcctgtaatcccagcactttgggaggctgaggcaggcggatcacaaggtcaggagttcaagaccaacctggcccatatggtgaaaccccgtctctactaaaaatagaaaaattagccaggtgtggtgacggatgcctgtagtcccagctactcgggaggctgaggcaggagaatcgcttgaacctgctaggtggaggttgcagtgagccgagatgtggccactgcactccagcctgggtgacagagtgagactctgtctcaaaaataaataaataaataaaaataaaaaataaaataaaatactaaatgggacacacttttacagtgcatattagaatatctgtagagcttaaattttcattgttttggctgttatgcacaaaagaaaaaactttagccgtttctttagtgaagcctcctttattatgaatgatctcttgataaaacgttgtttccacatacatgtagaatcgcagggtctgttagcgagagaaagattaggaaaagagcatctgtagtgtgatttgattgtcattattctgattttcttcattaccatgtttctgggcgaggataaaggaaattacaagaaattatcttctttgattattatcttcttcctcctttgatgaagtagagttctttgtggtggggtaaagaggcacagtgcactgacagattttttttttcaatactctgcagtgtagcctcgaagttaagaccttttcaacttaagactctccttctctccctgtaactgtcttgtctttactccaagcagacttggaagtcttcagctcctgaatggactgaaaccacgaaatctgagttccattattaatcatgtatttaccttagctaattgtgttttcaaaactttcatcctttcgtgtagttttatagggtatatgctctgtaagaattctcgttttcaggcttattgcttttcctatgccacagactccttcctttcttccttcaaacatgtaaagatctcttatagtgggtaacagtatgtattctagagccaggcagtcctggctgaagtcctgacttggtcctggctatctctgtgaacttgagcaagtttcttaacctctctgttttagtttcttcatctgtaaaatgacaataataataattcctacctcatatggttggagtggggattacatgatttaatactttgaagtacatagaagatgcctgatacataggaagtagtcagtaaatgttactattattatcattatccttttcatcatctcccatgctcagtcactgagatttgttaatttttcttttttagactctatcacatttgcttctctttgcccaccagcactgatagagttccagaccatgacattagtacctcatgcttgggtagagtactgccacaattttcaagagagcttctattaacaccctcctgcctctaattgctagtttgtgccagtgcttttcagtactagactaataacagtttgatattgtcacacccctgcccaagagctcacagcatttttcagaatcttgttttatcaagcccctattcccttacctgactctggcttatcattactctcttcctctactcaggcctgtcttgtattttctcatctaccttatgtacttggacatttgctcatgttcttcctttagtctttaggcccttccttaatgtccttacctttgtactcttattatttctgtcctagccatacataaagaatccaatgattctttcttttcttgttttttttttttttaattttgaaataaagtctcgctcagtcacccaggtggagggcagttatgggaagaatccagtgtttctaagagcctttctggatgttaagaactgagcttggtcaggaacaggattggtagaaatgggagagactcagactagaaagacaggttgatttagagatcagagtatggattggggattagagcctttaaatttaagaatgacaaagaggagctaaagtctgaaaagaagatctaaggtggaaggagcagtttaaggtgtaaggattaggaagtgaagggatggtatatgagtgacaactgagagcaaaatttctagggagtgttgaacatctgagatgtcgctaaggtttgagatagagctgggcagatccagatggaccagctggttttaaggtccacatggacaggcaagatggcgtacttataaactggtaagagaactagttaagatcaagaaccaggtgttagcagtctgaagcagtgagcagtgacgtctcaggcactcagagactggagttgtaacagaataaaataggtctcctggtaaggctctagtatcaaaattagcacaggataacatcaaaactgagtgtgctgagccaaaagactactaaatttccttctggctaagatcagaactgggttgtgagaatattgctgttttgaggcaacttgataggctcctttaccagaggtatagggctagagtgactacgattaattaaggccttcactgatttcagtgaacttagtgtatgttccatattattgagctcccaattaaacgccactactatcttgtattgctgtagtagacagctgtgagtctcattttctccattcatatcttaagctacttcagattaggaccatttttaaaaaagagccttgttgtgatatgattggcataccaatgtgtacatttaaagcacacaatttgatgtttgacctatgtatgaggataaaactatcacaatcaagaaaacgaacatattcatcaccctcaaaagtttccttgtgttcgcttataattcttcctttctgtacctgtacctctttttcccctctcttcccctttctatatatatatatatatatatatatatatataaattttttttttttttttttttttttttttttttaaagaggtggtatctcgctctgtcatccaggctggtgtgtgggcgtgatcatagctcactgtaatatagaacttggcttaagcaatcctcctgcctcagcctcttcagtagctgggactacaggcatgtgccaccatgcctcgctattttctagaattttatttaaatggaaccatacagaataagctatttttgtttgactttcttccattcagtatatttatttttacccccttaaaaaaaagtatagttattttgagtgtcagtagttcacttctttttattgctgaagagtattccattgtatggatatatctctattttttcatataccttttgagaccaggaaacagtcattctgtgcgtgataagagaattgactgaattcggagaccagaggatgaaagggaaaaatagtatggagagaaaacgagaataattatctttgtcttcgaaggaagtgagttgttataatagttgtagggtatttgttttggtctgacttgacttcctgttggtttatcatttttctgtaatagtctgctaatgctactgaagaggagtataaaaaaactcagttataggccaagtgcggtggcttatgcctgtaattgcagtgctttttgaggccaaggcaggaggatcacttgaccccaggagttcaagaccagcctcagcaacagagaactcaggtctgttaaaaataacaaatgagccagataatggtggcatgcgcctatggtctcagctactgaggaagctgaggcaggaggattgcttgagcctgggaggttgaggctgaagtgagccatgattgcaccactgtattgcagcctaggtgacaaagtgagactctgtctcaaaaaaaaaaaacaacaacaaaaaccaacctcaataatcgtgttacatagcaacttcaagtaaacttgaacacctctaaatttgtctttcagacaaaaaaaaattacaaagtatttttaaagtttagaattggaacacagtatagatcatgtgtttcctaatttcttctagaagtcacatcattaactacattgttatttaacatatgctctcaattctgttgtgtttaccataggtactgtatttatttcaaggtttttctttctagaatatcttgattttgaatctgatgattaagtttaaaaatattttgttttgtagccatgcaggatatacgtactgtgggtcttgtgctgcccatgcttataaacaagtggatccgtctattacgtaagtaatgtagttttgttttaagtcggagaagcttgagaatttattgctttgttatagaagtaatttgctttttatacttattgttattatgtactcaatttcatgagggatttgacttttgatgaattttactatactttgtataggttactgaaaacttcaatacttcttttttgttgttgttggagcatttgatttttaccttccctttggcatgtaaaatgtttagttatgaaggttaaatattttgttttttgatatttctttgaaaacccagagatgagcattcttaagaaaaatgcaaagccctctgatctgttttaatcatttcgtaatttaagattctttattgtacttgttaaaattgtggttactgaaaggataatttctcgttgacaggataaggtatttgaaatattttagaatctgacagtgaatttaatatggtgtttgaggcatattaactcttaataattcaatgacagctctgaaattagcttagaaaaaaaaaaacttcctgggaacttgagactcttttaatagtatactactctgtaagaaacttgtgaacttacaagaggttttgctggaaatagtcactcattttatttacacagttaatttactagatatgaaccaatatctggcccttctttgccagatgtacaagctatgtgaataggtaaagcgatcatcttagttctgtcaaatactgattgttaggtctgaattagtagagatgtaggatagttattcaaaagaaatagctcatagcagccatgatttaataaagaaaatcatgcacagaccacttgcctttgagcagttcattcaaagttttaaaacaaaaaagctgttctttcaaatttttatgtagcgttctctgtacattgtattataattcattgaaaattatttttagcaagtttttactaaaaataaagcaataatatttctaaattggtgaggttttggctagccctgtctcatttatgatgttttgaggagcattgttaacaattattccttgatacatgcttaatatataatcttaagtaatttcatgaataagagcaaatagaagttaaattgaaatgattttttagtctgggcctggtggctaacacctgtaatcccagcactttgggaggctgaggcgggccgattacctgaggtcaggagtttgagaccagcctggccaatatggtgaaaccccgtctctactaaaatacaaaaaaaaaaaaaaaaaaaattgccaggcgtggtggcacacgcctgtagtctcagctacttgggaggctgaggcaggggaatcacttgaatccgggaggtggaggttgcagtgagccaagatcgcgccaccgcactccagcttggcaacagagcaagactgcgtttcaaaaaaaatatatatatattttataagcttctttcatttgacttgggcctataaaccagctataataaaagttagtttatataacagccttttctttttgaaaccttcctctatttggcagaagttttattgataaaactcctgtgctgatgggacaccccagagttaaattaggtttaggaatttgtagaggggtatagatagagtttatgttcatagaagtggaaagcatgtgttaaataggttaatggaaagtgagaaagaaggcaaaaggaaagaggaaaaaatggaagagcgccaaggactaagaagaggaagatttaagaagatgagtagaaagagaggcaaatgatggctgatgtgatcgaattattttattctaattaattaattaagtatttttgagacacagtctggctctgtcacccatgctggagtgcagtggtgcagtcttggctcactgcaacttctgcccccaggttcagtcagttctcctgcctcatcctcccaggtagctaggactacaggtgcacgccaccacactgagttaattttttgtatttttagtggagacacgctttcgcctggctttggccaggctggtttcaaattcctgactgcgggtgatccgcccacctcggcctcccaaagtgctgggattacaggcatgagccactgtgcccagcccgatcaaattattttttgtaattagtatataataactgaattctgaatgaataaattttaaggtctaagtgtaaaattaataattgacagtcacagttgaattctcttgaaagaggcactctctgggaattatagtgtctttagagtgctttgagaaagtagaggaagaacatccttagagaaaggttaaattctatactaccactttctattcttaccttccacattaatccatttttgttctatatttcagccaggatcatcttttgaaaatgtaaatgataccctgtcactttccagaatttaaaagtgggtggggggtacaaatatgattttaaaaggcattacaaataacaggtaaaaattattccaaaattgatgatagaatgctgactagcagcttggaaaaagaattggtttagaacctctgctaacaccatccatcaaagtaaatactagttagataagggtattaacatatctggagaggaatttcaagccacagctaatttggaacacaatatgtcttaatgtttatgagacattgttgggaagagtataaaacatgataaattataattaaattacatgaaaaaataactcatgtcataatgtaaccagtggaagcgatgaacggaatgggaaaaatatttgcaaaaaaagacaaaggataatatcaaaaataataaaaatcatagtacttagaggctaaatcatcaaagaatattaactgaaattacaaaaagtaaatgtaattaataaaaataaaaatggaaatatgttttatttttcaaaaaaatggaaataaaaacagtagtgaggtaccaatttaaatgaacagtttgaagaacaatacagctatgtaattcctgtaatccagaactggctagattatggcaaaattagttttttataaaaaaatgcatttcaatggactatatcaggttaatactttaggaaagcaatttgataatatatattaagagtcataaaaatgtatatagttactggcttagaaattcacgttcggaagctctatcctaataagtcccaaaatggaaaaagttaaatgtgttaggttttctacagcagcattgttttttaaagagtctaagtttctgatagtgcattgactaaataaaaaaagcggggtataacattgtgtaaaattgggaaaaaagagaatgtactatatgaggttaaataaattattataacgaatgctaatagtttgcatgtgttttcttatatgagaaatggatatatttttatggtaaaaaatataaaatttaaaagcatttgtgcaaaaatgattacaagttgtggggactaatgattcttaaactgacagaatgattctttgatttataataggactggtcagggtctaataagatttttctttttcttcttctttttttttttttttttgagatggagtctctctttgtcacccaggctggagtgtagtggcgcaatcttggctcactgcaacctccgcctcctgagttcaagtgattctcctgcctcagcctcccaagtagctgggattacaagcgtatgccaccaggcaggcctggctaatttttttatttttagtagagacaaggttttaccatgttggctaggctggtctcgaacacctcaccacaactgatctgcctgccttggcctcccaaagtgttgggattacaggcatgagccgctgttcctggccaagatttttcttttcacagtaactattagggggctgataacttaatggggagtgtgagaggcagcttttgaggtgataatgaagattgtttacaaacaaacttgcctgttctatgaagaattggtagcaaaggttttcaggtgttgttttccaagagaaatggatgaataaattaaagcatatttattttaaaagtttattaagtgactgctatgatccagatattgtggtagtgctagagacacagtgattaataaaacaggcatggttttagccctgtgctgctaaattggtaggtgagatagatattaagcatatgataatgaatatagatatcttattaaaagctaaaaatttaattaaaaagctgaaagtgaaatacagtggttctcaaacatcttggtttcaggaacccttaacttattaaggacaccaaatgtagaccacatctacctttgtggaatgcattcaaaattaaaatgagatacttaaaaaattatttaaaaaagtaaacaaattagaggttaataaaaataacatttttaaaaatgagaaataaatacattttctaatagaagatagtgggaaaagtggcattgctttacttttttttttttttttacaaaatataaaaatgtcttacagttttactagttattaaatctccttttaatgtttggcttaataaaagacaactatgttttcatatctggttatgcattcaccctgttttgatcatttgttttagttgacgtatatgaagaaacctcacacagatatgtagttagaaaaggaagaggagtagtgtaattacctttgcagataattgtggatatttttctttaatactacaccaaaactcaacaaatggtagtttcttaaaggttagttataatgcgaaatctgaagttactatcaatgaatttttgtacttatttttttgagacaaagtcttgctctgtcaccaggctggaatgcagtggcgctatctcagctcactgcaacctccacctcctggattcaagtgattctcctgcctcagtctcccgagtagctgggactacaggcgaacgccaccatgcccagctaatttttgaatttttagggtttcaccatgttggccaggatggtctcaatctcttgaccttgtgatcgacctgcctcggcctctcaaagtgcggggattacagatgtgagccaccgcacccagccgaatatttgtactttgtataaattcattgtctgttttacagtttgaatggctcttttaccctggcataattttgtaacgtgtggagcatttggaaaatttttattggattatgcagatattttcaatgctggtatttcattatatgatagtaaaaaatcactttttgttttgttttgttttgtttatttttcttttttttttgaggcagagtttcgtgcttgtcgcccagctggagtgcagtggcaggatctcagctcactgcaacctccacctcctgggttcaagggattctcctgcctcggtctcccgagtaggtaggattacaggcacatgccaccacgccctgctaatttttgtatttttagtagagacggtttcaccatgttggccatactggtctcaaactgctgacttcaggtgatccacccacctcggcctcccaaagtgctgggattacatgcgtgagccactgtgcctggcaaaaaataacatttcttaatgtcaccatgtattttatcagaaaaaatcattaattctttggaggctatcaagcttacagtgataaaagttttatgaaagtccaattttcacttgaaaaccttaattttatcattgacaacaagtatattattttctttaaagtgctagattctgtttttttttttttttttcccttttgagacaggatcttgctctgtcacccagtctggagtcagtggcatgatcatagctcacgcagcgttgaattcccaggctcaagtgatcctcctattccagccttctgagtagctaggactgccagcctgtgccagcatgcctggctattttttaaaaatttatttttgtagagatgtggtctcactatgttgctcaggctggtcttgaactcctggcctcaagctgtcctcccacctcagcctcccaaagtgctgagattacaggcatgaaccaccgtgcctgacttccattcactttggggaaatcttctgccagctacctaaattggaatagccgtaatttatctacagttgtcttttgaagtaaaaattttgttccatgaggaaaatgtctggttcagcttacaactcaaaactacacaactgctttttcctgaaacatacttccatatgcagcagaaatgttttatcaccacagattgaatgcattttgtcatatagaatattaaaaagatacctactcgagagtcaagatttaatgaaattaggaactcccttttaaacttagtgtgagtaaggttaaaaaataggactgctagtgcatgttgatgatactgctttgatctttgttctaatgggccagtggttttacgctcccctcacctttgcaccataagtgcaaatgaaaaaagtaaataacttccttgcattcttatgaaaatagttttaattttatggactgctgcatagggtcttgaggaaaaccagaattccagagttcacagtttgagaactattgtggtagaccttaagagggtgacttgatttaaattgtgggaaaggtattggggaaagtatctccgggaacagattttttttttttttttttttttttgagacggagtcttgctctgtcccccaggctggagtgcagtggcacaatctcagctcactgcaacctctgcctcccgggttcaaacgattctcctgcctcagcctcctgagtagctgggattacaggcgtgtgccaccacgcctggctaattttttgtatttttagtagagatggggtttcaccatgttagccagatggtctcgatctcctgacctcgtgatccgcctgcttcagcctcccaaagtgctggcatttcaggcatgaggcactgcacccaaccgaggaacacattttttaagccagggtagccaagcaatggggaacaatagcatgggtgaaaagtttgaagtaggcaaagttgttggtgttatcaaggaactgcaagaagaccagtatacatcaggtattatgatcaaggtgggcaagagtaatagctaatttgctagggcatttaagagtgtagagcccattttaaggattctagattttatcctgtgaccatgaaatgccataaaaggctttaagcaaggaaagtgatatgatctatgtttccagaaaatcactttgactgtttaaggaagtttaacaatgatacattttagttcttttccatattggtagttgactattattaaaactctaaaaactcagaattcaggatgtccttaggtagtagtaacttgattttgatacatatttttcagcaagccttgcaggacagaaaaagagagcaaaaaggaatgctttttggggccagatgacattttattctttggttaaaatgtcttcacttcctgtgaaacacgtttacaaaattacttatgttccattatttggactaagtagctgaataaacagtcatgagggtacacactcaggcagcttatacattgggtgcacagactatcattgcaaatgtgaattctctattatagctattatatatgaagtacatttatttctaagagaatgcctactgatcttgctccttccccccattttttcgtgttaaaggttttttttttttttaacttgtgtatcaccgatgatgtgctaatattgaaaagttacgcctttaaagacaaagcaccttgcagtcaaataaaggaagagaaagtggcattgcttctaatgcctctattatttatttctcttcaaaatatccctgtggccttggtgtttacggatctagcattctaacaaagaaaatgcatgaactttaatgtacactattcattttttttgttagcatttagctaacaaggagacccattttgagattacggctggtttaaatgtcccattttactttcctttcaatgacatttagctttttctggttttgtttttagatatattgcttttaagggttttatattgaggggacttaaacctttttttcttattatttcttttaatcaaatatggaacttgatttggctattggtgagttttctaccaaaccagaaagaatctgtagagtacagaattggttaattcagattggtggggctctttttccttcatctagattggggcagacaaaaaggcaaacaaggaaagtagtcaggtatcagaagagttaattaggcttccagcagacctctggtgtttatttctggagcagtgtatcttttggctattgttagaaccttattacacttacttaggaaatttatgtatgccttgaatttagattgttattttaaaaatcacttcatattttgactgtgtgtttcagattttccaggagtgctctgatgttaaatatcctttctctctgtcttttcatattttcctcaatcagaaaaatgccctttctcattatttgattcttggttcatatactacctggccctagtcaggctacctaaacatttctgagttaccattctctatagcccacgtaagcctttaatttaaaacaaagtgtcatgttatttatgtgctattaagataggtgaccagagtgctatcttttagtttttcttcatttagaaatctatagatttgactttttttttgaaatggttctcgaattgatgatagaggtgatgacaagaagtgaggattagcagtgctaataattacatattgaaggaagagaggtagaaagattctgtcgtctataaggaacttaaattaacgagcaagaaacaatccagttgaaaagagggcaaaggacatgaacagacacttttcaaaagaagatacatacgtggccaacaagcatatgaaaaaattctcataatcactaatcactagagagatgcaaatcaaaaccacaatgagataccacctgataatagagtggcggttattgaaaagtcaaaaattaacagatgctggcaaggttgtggagaaaaataaatgtttatacattgttggtaggagtgtaaattgattcaatcattgtggaaaacagtgtggcgatttctcaaagaacttaaaacagaagtaactctgggccccgcagtcccattattgggtatgtacctgaaggaatgtaaattgttctgccataaagacatatgtacacatgtgttcactgcagcactgttcacaatagtaaagacaaggaatcaacataaatgcccatcagtggtagactagataaagaaaatgtggtacatatatacactatgtaatattacacagctctttaaaagaatgagatcatatcacttgcagcaacattgagctagaggccattatcctaagcaaactcccgtaggaacagaaaacaaatactgcatgttctcacaagtagaagctaagtattgagtacatatggacgtaaggaagggaacaacagacaccgagacctactggagggtagaaggtgggaggaggatgaggataaaaaaactacttatggaatactaggtttattacctgggtgtccaaataatctgtacaccaaaccttggcaacacgtaatttacctatattacaaacccgtacaggtacccttgaacttaaagtaaaagttaaagaaaaggataatctgtttctgaccagaaatggcctgtggatgaagtcttaatgtttgctgtatgtgctgtcttaaggaggttttgggactctaaactgagaatcacttacccacaactttcttttttttttttttttcatagcagaacaacttaatatccacagctttatctcctccctgcaatttatgaagtaacatataaccaataattggttaattttcttagctgtaatagaattttatgagaataaatacattgctaaagcacacattccctggcctgcaaatttttgacagaaaagaactagctcatctctcagcttttgttcattaattgagcaatcagtaatacttttctagctacatagcatatcatatattttcttctcatagttttggctttatgagtctgtaagttttgtatgtgatgtgggaaggttggttcatatgaattttggagaacagagaaaattgatagttttggaattcagattgtagggcaggtttgggtatttgacagaatgagaggaaattaacattactcttgatgtcaagataaagagattgtaaagatttaagctacactttagctcagttcttttctttagactacagtgcaaataacacataatctagtttctttgtttttgagaatgacttctacttgaatgggaatagagaaagcttattatatagaattcttttcaacaagatgcctttttcaccctaccatggaagaaatatggaaatagctttatcagaatgcttttttataatggatattttgtatagatatttagaattttatgctattatgcatttttattaaaatcatggtggatcttagaaggttattttagaatgtgttagaattttgaaattttagtagcttaaatgcataaaatccatttaataaaatacagcttctgaatacctgttgcatccttgtcattgagagtatagagattattttatgcatagtgggttggtttactgtattaattgataactggtatttccaagtattgaatatgattctcttaaaggccatccaacaaagacagaaataaggaattgaacttaactgaggagcaagtcattattaggtgtattagtttgctagggctgtcataacaaaataccacagattaggtggtttaaacaacacaaatttattttttaacaattctggaagcttgaaattcaatatcaagtttctgtcagggttgggccccttctgacatgatcatatctctgtgcaggcatacttctggtgtctctttttcctataaggacaccagactcattggatgaggtccccactctaatggcctcatttgaacttaatcgcctctttgaagaccttatctctaaatagcactacagtctgtgctactggggattggttcttcaacatgtgaattttggaggggaacacagttcagccattaacagttggtaattaagaaggaaaacaagtgatttgtaagaattacttttttctcttttatttaataaggtttgtgtagaagtgcaattgttacgtgtttttttgttgtgtatctcctagccggagaattttcatccttgggccttctcatcatgtgcccctctctcgatgtgcactttccagtgtggatatatataggacacctctgtatgaccttcgtattgaccaaaagagtaagtatatagaaatattatagctttcaaatagctaatgttcttttaacaggacttgtaaattaatttaaaaacttatgaatatcataagtaatatctcaatatttaaaataaaaattgttataactaatctgcataaaacagcaaaaaaagaaactcttccatatccctaaaaggcaactagtgttttttagctagctacagaaatctgtcagatctgccagtgtgcagattgtagtggttacattaatattcagaaaaatgccatgtactcagtgtaccaggagacaaaaaattagtacccataccaatttcataaagattctgggcgtgttaatttacttccatgtaacgccacttttctcactgtaaatagataatgctgataatatctttattttctttcaaatgatttttatgggaaaaaatgagcctttaattatgaaactctgaaagaaaggtgctatataaatgataaatatattttatttttaaacatgcctacaattttggttgatttatttttttccataggcgtccagagtcacgtttttatttagtagttcttacacaatagatgtataaagtaaaaatcttttgattttataaaggtattttttcttttgggggggggagtaattttaaaaatatagaacagtataaagagtactataagaaattaactgatgtacttaacatccacaatttattcagaatttctcgctcatcctgaacccaatttaccttcccagaagtaaccaccttcatgatctgggtatatgtcctttcagttagtcaaattattcacacacacgcatgtacacacacacacacacacacacacacacgtgtatgtgtgtgtgcatgtgcatgtatacatatgcatatatatgtacacacacgcccatatgtgtgtatatatataaacacacacacacacaccccgacacacacatatatatatttttgtttttagagatggggtctcactccgttgcccaggctggagtgcagtggcatgattatagttcactgcagcctcaaactcctgggctcaagtgatcctcctaccccagcctcccaagtaggtaggactacaggcacacatcaccaaacccaattaattaaaaatattttttttggtagaggtagggtcttgctatgttgcccaggctgatcttgaactcctggtctcaagcaattctcctgtcttggcctcccaaagtgctgggattatcagtgtgagccactgtacctggcctcaaattatatttttaagtatgttaggggtgctattgtttcaaagaattttgcagaaatttcttgtatagaataaaagagtcaaggcctagtgtggtggttcatggctgaaatcccagcactttgagaggctgagatgggcagactgcttgagctcaggagtttgagaccagtctgagcaatgtggcaaaaccccatctgtacaaaaaaatacaaaaatctgctgggcatggtagcacgtagctgtaggttgggggagggcatggggcagcgaggtaggaggatggcttgagctccggaggtagaggtttcagtgagctgaaatcattttgctgtccccagcaaaatgctgtcacccagcctggcctgggtgacagggtgaagccctgtctccaaaaataaataaataaatataaaaataaaataataaaagagtccatttgcaagaaaaaattcttctttcttatttttggcataagttttcataatttgaggctttaggtatcacacaatattagcaatttgttaatgcgtcttattaatgaaatgagtatttctaaccttacttcctgagagggttttagggaacacattttacttttaaaaccttgttggggcattcagaaaattttaattttgggtagcttgccagtgaagaaatagagaattttttcaagaaaagaggtcatacaaccatttatttctttctttgatacaggtaaacccatttaaggatctaattataaaattggttctattctatgctaaaaatattcttatacatattttttacatgttaacttttatctttttcttgttccacaatattcaattttaagcacagttcatcagaaaggcctgaattactaggtgttttaaagttgggacggtattgtggcgaatttatattttgatccatcctacaagcttaattttgaattttcaggaaaatagcattagtgagaattttctcttcttggtatggcagaaacctcaggtgtgaaataataccacacattttattaaaaaacaaaactcagaaactgtgcttttgacctcatgagttaaatagactagtggtttttccatatttcagtaggaattctaattatgttcttgctagcatgtactgattaaagtcaaggaaaagcctagacccgaaggtgattttagaaataatgaaaggagctgatgaagaatttaaattatcattttttatataactatgtaacatatacaaatgatgagtaagtctttacacgtattactgttttacctgttacataaaaactagttctgtttttttctctttctccttactctccctccttcctttcctttctttctattgttttgttttgttttaataaaaatgagaatattatatggtgtttctgtctcttgccaaaaagcatgtagttttgtgttactgggtggaatctcacaggataaggatatacattaatatatttattttactgtattttgaaatctctttagtttacggagaactgtggaagacaggaatgtttgaacgcatgtctctgcagacagatgaagatgaacacagtattgaaatgcatttgccttatacagctaaagccatggaaaggtatattgattgatataagaaatccccaggaaatcatagacattaatttctttggtaatttaaaactagtaaatcctagtaattatcagggtaaggagattaagatgtgagataaaaaattgagacaagaatgtcttaaggtggattgttggttttgaatagtttgcctatgaaggctgaacatacgaattgacatgatggttttattaggtggaagtattaaaaaacccatgggtatgtgagtgtatgtgggtatgtatatatcttgctttgcttgtattttattcattagacatttctttatctcagaataataattacattcttttatggtacaatgctataattaatcgtaaaattttaggcttgtatttaatgttggaggtcatttatttcaaccttgtgcaaggtacatgaatctcttttatggtatgctcgacagactgttacgtggtacctgctaaaggtcttcctgtgatgggctactcactgtactgtgagccgaacgaggacagggacaatatctattttgttctctactgtataccccaccgcctagcacagtgtccagcacatagtagttattatgtattttgataaaataaaaaaattatttcaagggttttcttcttttagtgaaacatttggattaggaggtcttctcttttgtaggtttctctaatttttaaaaccatttcctatatatggacttaatatttcatatttagtttggcagttctaagtatggtaagatgattccttctggatttgttcattatattagtaaagtacatgatgctctgtacgctctcagtaaatattaattaaatgtactaataaagtctaagataacattatattttttatgttgatgtagcttactgttggcaaatgtacttgtgatcagccaaagcccaaggccttttcataatattcagatggattattttctgttctcagacttttgtgtggttatttcttttttaccctaaatatgtatgtcttctcaattattgctgtttagtttttcttgtttagttcattatcgcagtctttttggattgttttccactctaattctgtattcaaagtattatttacttttctcaatcttttgtctgcttctgctcacaatgataaccatgaggaattatataaatctgaagaattttcaaaaaatcagtgtgatactacattataagcaatataattttagggtttttaatacatcctaattcttcagaaatgtgaaaccatatatattacttcttgaattgttgttgtaatcagaactttctcttcttcaaccggaaaagacaattgaatattgttattcactgagatgtttgcatattttgtcatgagaaaatataatttagacttaataaatactaatactttgggtgcagtggtgcttgtctgtaattccagcactttgggaggcggaggtgggcacatggcttgagcccagaagttcaagactagcctgggcaatgtggcaaaactctgtctctactaaaaatagaaaaattagcggtgtgtggtgtcgggtgcttgttgtcccagctacttgggaggctggggtgggatgattgcttgagcctgggtggttgagactgcagtgagccgagattatggcactgcactccagcctaggtgacagagtgagaacctgtctcaaacaaacaaacaaacccaaaaaacaataagaccaataaactgacaacaatatcctcaaggaggttataacaaaataacatttttattgttattttaaaagtaaaacatgtatattgtggaacatttaggaaaatagaaacttaaaagccagcaaaccaaattcctatttataattcccccttttaaatagtatcaaataaactactgccacattacattagggtccctaatattgacccttagatagtacttagtgtcttttctttgtagcattagttggactcattacctatgtcagttatttattactaagtaacaaaacctcttacttaaaattacctatattagttatcttttactaagtaaaagtaacttagtaaaacttagatttaaactgtgacttaaaatcacagctgtttattgcctaaaatttgggggccaggaattggggcagagaacaccttgctccggtccacaagacactgacttaggtggctcaaatggggctacagtatctcagatagcatcactcctgtgtcttgggccttagtgctggctctctgttgagacccctcatttcttctccagctgacctgtttgttcttcaagtaggactttttttttctttcttttttttgctactctctagaagaatagcttagacttcttcttctttttttttcccccttctgtttttggatcaagagagtaaaaccagaagtttctaggcctattatgtcctaggctggaaactacatagcacatttccagtgaattgtgttttccaaagcaaataagatcactgtgtcagccaagatttaaggaaaaaagcaatatattgctcctcttgatgggaggagtagcatgtatatacaggaataagagaaactgttgacagccgtctttgctgatagtctactacagttcttcctctggtggacaattcatgtctctttaacatgtcatatacacccagccctcccaggatgttcagaaatcttacttgctatgaccctaggctcaaaatctattatcttgtgatctccatcaagttaggatgtgaatgaggctccttgagtgtggtttctctttttttggagaagtgggtgttgggggaaagagtctcagctctgttgcccaggctggagtgcagtggcatgatcatggctcactgtagcctctgcctcctggtctcaagcaatcttcccacctcagcctcccaaagcaatgggattataggcatgaaccactgtgcctggcctctttttttttttttttttttttaaaaagagacagggtctcattctgtcacccaggcttgagtgcagtggcacaattataactcactgtagccttgaactcctaggctcaagggatcttcctacctcagctttcagagtagtggcactacaggtatgtactaccatatctggctaattttaaaaactttttttttaagagacgggagcttactttattcctcaggctgatcttgacctcctggtctcaagtgagcttcttacttcagcctcccaagtaatgtcttagttacctattgcagcataacaaatcacctcaatgtatgcattttttttaattgaaaacaaattttttaatttttgtgggtgcatggtgtatatatggggtacatgagaagttttgatacggtcatgcagtgtaaaataatcacatcatggagaatgggatattaatcacttcaagcatttatctttagtgttccagacaatccagttatattcttttagttacttaaaaatgtacaattgagttattgactatagtcaccctgttgtgctaccaaatactagttcttactcattttgttttgtatccattaaccatccccacctaccctttagccctccactattcttcccagcctctggtaatcatccttctactctccacgtctgtgaattcagttgctttgatttttaggtcccacaaatgtgtatttttttcacttacgattctatagtttggaaatttggtagggtcagtggagataatttgtctctgtttcatctgctgccaattgaggcagtttgacttaggctaaagactccaagatgccctagcttcctctctggggccgtggtgctggttgtcttcttgaggcacatcagttttcatcttggttctcgtctatctctgcctgttgacactcacccttcaggacttctctcttcacgtggtgaatcctctctagcaggatagcaattgagcaaaagtagaaatttccagccctcttaatatcgaagtctagaactggcacagcatcacttatgcctcattctactggtcaaaccgcatcataaggctaaattcaaggagagggaactagggatgctatttttgatgggaggagtgacattgagcattgagaggtgggaagaatttttggtgattggatttgtagaaactgtggttaaatagttgacggattatttgtatataagtctgtgtcccttccatggtagttccataatgttttctgcctggagcaactagtcttgaccgtatctgctatgcatagcacagtacctggtacacaaaaagatttcagtaattgattgttgaatgaattaataactgtcttgccattttcagtactttaattatttttccaaaaagtggatcaaatgttctttttttaaaaaaaaattacatgtttttttaattttcaaaaaataaaaaaaaaaaaaaactcttaatcatctttggctacaaatactcttgttttaaactgcttttcttgtcatgaactcatttccctgtcatttttttactccactttataggctatacctgagactttctagtaaagatccttgtaatgctttaatcagttcttgaccatttagcttttaagcttccccccatttttcactattataaaccacattttgtattttttaaaaaatagatgtctaaggtattatttaaatttctgcttttttttttttttttttttttgagacggagtctcgctctgtcaccaggctggatcatggctcactgcatcctccgcctcctgggtcaagtgattctcctgcctcagcctcccgagtagttgggattacaggcacctgccaccatgcccagctaatttttgtatttttagtagaccttgttggccagaatggtctccatctcttgacctcgtgatccgcccgccttggcctcccaaggtgctgggattagaggcatgagccaccatgcctggctgcatgtttttaatagatttaaaaattgtattcattagagctttttaaaaaaatagtagtctaaaggagaaaacataaaatgacttacaatctcattgctcagttaactctactgacataaaaaatatacgtgcatggttagaaaatgtaaatagagtcaagaagtacaaaatgaatggtggaagattctggttctactcagccagtgtttactgccagtaaaggtttttatgcatacactaacatatatttttgcatatgtaagtttgtgtatatatgtaaaatttatacatacacgtttatgtttgagttaaaatatataaacaagagatcatatcttatacactttgttctgtttttttgcatatattaaaaagtttttttcttatgattactttcttttgtatgtcaccatatattatctttaatattgaaatgcataataaattttactattataattgctttttttttttttttttttgagacagagtttcattcttgtcccccaggctggagtgcaatggcatgatctcagctcactgcaacctccgcctcctgggttcaggtgattctcctgcctcagcctcctgagtggctgggattacaggcaagtgccaccatgcccagctaatttttgtaattcttttttttcttgaggcggagtcttgctctgttgcccaggctagagtgcagtggcatggcacaaccttggcctgctgcaacccccacctcccaggttcaagcgattctcctgcctcagcctcccaagtagctgggattacaggcgcccaccaccacgccagctaatttttttgtatttttagtagagacagggtttcaccctgttgaccaggctggtcttgaactcctgacctcaagtgatccacccgccctcggcctcccaaagtgctagggttataggtgtgacccaccgctcccagcctataattgctttttataattgctcttgagggaggttcaattcagattcagttaggatatatagaaatcatgtagaaaaaattagtatcttccaaaattaacagcattaggctgggtgtggttgctcatgaggcctgtaatcccagcactttgggaggctaaggcaggaggatttcttgaacccaggagttcgagaccagcctgggcaacaaagtgagtcccctttctccaaaaagtaaaaaaaaataactggatgaggtggtgcacacctgtggtcccagctacttgggaggctgaggtgggaggattacttcagcctggaaggtctagttatgttcatctgttatgtttatccatattgatgatatttttgagttccctaagtgagaatgctacattagatgcttttatatggcattaaatactactcctacctaagcggtttttcctgttcttaacatcttgaattagtatggtacatttgttacaactgatgaaccaatatcgatacattattatattaactaaagtctatagtttaattaggattcactctttgtgttggatagtcttacggtttttaccaaatgcctattatgtctctgttgttataataccatacagaatggtttcagtgccctaaaaatcagtgcttcacctattcatcgccttcttctcccctctccctgagtgcctagtaaccactgatcagtttactgtctcagtagatttgccttttcttgaatgtcctacagttgggaatcatgcagtatatagcctttcaaattggctttcatttaacgacataccttcaagattcctccatgtctttttagagcttggtaacttctctttatcactgaatagtatttcattttttgtttcattttgtggatgtaccatagtttgcttatccattccacctcctgaaggattgttgctatatttaattaatatctaccttacttactatccttttctaatcattgccaatcttctccccctttttttttgtcttccacttttttcctgccttctctggttttaattgtgtgttttatatgactataattttttcctctcatcatatcatttatacatatatatgtttatattgtttttattactgtcttttagtttttgcagcatacatttacaactaatttacaactttctttattttttatttttttgagacgggctcttactcttatttaggctggagtgcaggggtgcacaatcttggcttactgccacttccacctcctgggctgaagggatcctcccacctcagcctctcgagtagctgggactacagacatgcaccaccatgcctggctaatttttaaattttttgtagagacagggtctcactatcctgcccaggctggtcttgaactcatgggctcaagtgatcctcctgtcttgtcctcccaaagtacaggattacaggcaggagccactgcacccggctaacaactttcaaataacactatactgcttcatgggtagtagaagcatcatgtgagggtctttctaatttctccctcctgtcccttatgacattactgtcatttgtttcacttatccataagctataatcaccaaatacattgctgcttttattaatttgaacaaattatttgttagatcaattaagaataagaaaaaaatgaaataaaatattttattttaccctcatttgttctttctctaatgtacttgcttgcttgctttatgtagatatagttttctgacctatatccttactcttctctgagggacttcttttaacatttcttgcaaggcagatctaatgtctaaattgacaaactccctcaatttttgttagactaacaaaagctttatttcttctttaattttgaaagaaatttttcctggatatagaattctaaattagtgggtttttttctttcgctatcagcactttattttatcacttcttgcacggtttctgaagagaaatcttacataattcttatcatttttatgtttcttatcatttttatccatgtttgtctattgataaagtgtttttgtcctctggtttctttcaagatcttttgtttgtctttggttttttgcagttttaatataatatacctaagtgtcaatttcttggtatttatccttcttggagttctctgagcttcctggatttgtggtttggtgtctgtcattaattttggaaacttctcagtaattactgtatttctttctctccttctgctattcccattttatatgtgttataccttttataaattttaggatttaaaaaaatttctttgaagaatgtcattggtattttgataggggtttcattaaatatttaaattgtgttgggtagtatggacatttaaacaatattaattcttccaatccatgaacatgggatatctatccagttttttatgtcctcttcaattcctttcatcagtgtttcaaaattttcctggtatagctcttacacttctttggttaaatttattcctaggtattttgttttgtttttggtagttattgtaaatgggattgctttcttgatttctttttcagtttgattgctgtttgtatatagaaatgctactgatttttctgtgttgattttgtatcctgcagctttactgattttgtttatcagatcttagggtttttggtggagacttcaggtttttctaaatataagaccatgtcacctgcaaacaaggataatttgactttttcctttacatttggatgccctttatttcttctcttgactaattgttctggctaggtcttccagtactatgttgaattgaagtggtgaaagtgggcatccttatcttgttccagatcttagtggaaaggctttcagtttttccctgttcattgtgatattagctgtgggtttgtcatatgtggtctttatcatgttgaagtatgttccttctacacccaatttgttaagaggcttgttagatgaggtccaagtcctgcatttctttcagttactttcccctgttattacacaggtgccctgttgatgtagtggtaagatgaggagaggagacacattctataattctgtgatcagttgtaattcttttggtgagcctgtgccactggtctgtgacttaagaagttcttctcagattttctcccactttaggtcagacaagaaggctggagggggctggatttgggtattacttttactccaagtctgttaaactcttgtaaggcccaattttgttaggctctggtaaaatagtttctcttgcagttaggcatttttgtaaagagaacagaatactcagtgaagtgggtatttgttggggcccttggaagtaaaactttcataaagccttctacagcttgattccttggctctcaggagtttgtatctctcagggtagtccacatttagtctccagcaattagttcattaccctttaagtattcctgctagctccaagggtggtttaggattctctgattctgtccatacttccagtttttggggcattggtttgctctgtcacctcaattctcagatagatctgataagagttattggtttttaattcacgttttttttttcctgtcaggataagagtaataccttctaaaatctttacatgttaggttagaaactggaaatctctttcattgttttttttactctcaccatatgggaggaagtctgaagtttcctgaaatcttaactagcacctgtttatatcactacctgttttcattcttaaggaagattcagtgcattctgtagacagtcactttaagcactgtgtgggtaggactggagttaggaagagagggtcaagggtcaagaatgtttaggaaaaaaaggtagacatttacaaatctgagcttctttcatttttttaaagaaaactcctctaaatgaattattgaatgacccaagtaccatgtaaaggaattataccagtttatagctctaatttcactatttaaaatttgctattttgtggtggttgtaaaaagaattttttttaccatttaactttaccaccttctgaagaatacacagaataagagactcttttctgatgtctctcttaaccacagattaagaataatgcattttatatgtgggagtaaataaataagttaatgaaactcattttggcttccaaatggtaatttttcatcttttctgttttgctagttgtactagttgtgtgtatgtgtgtgtgtgtgtgtgtgtgtgtgtgtgtgtgtttaagacacggtcttgctcctgctggagtacagtgatgtgatctcggttcaccacaacttccacctcccgtgctcaagtgatcttcctacctcagcgttccaaatagctgggaacacagatgcacaacaccacacctggctaatttttgtattttttgtagagggggtttcgccatgttgcccaggctgatcttgaactcctgggctcaagtgatctgcctgcctcagcctcctgaagtgctgggattacaggtgtgagccactgtgcccggacttactagttatgttttataaaaattgggttgtttttaagataacatttactgtcaacattttaagatttttaaaattttggttaaattgaatttttcaaatatagtagatgtacctaattgtactaatctatgtttaaggatggagaatacaaaaataaggaaacaccctatttgttttctcatcttgtagccttgtagaagagataagaaatgaatataaatgattataatataattcaaaatgtactaagtataattaaagagttacaggagcagagagtagggatttgggaggaaagaggtaatagttgagttagggaagcacagaaagggcttcattaagggggtggcatttgaatggattttgaaggtgcctgcagttttcatgggattaggcataaggttttaatgagaaagggagttatgtacacacaaagtatttagtagtaggaaagcccagagcttatttttaatagcaggaaactatttggcttaacttgcaggagttgtaaaaggcttggctagtaactgagatctgtttgtagatgttttttgtctgggttgcatagttagaaaaaaatttttttatacagatatttatagctagatattggtcctaccattccctattatcttacaccttgtctaccttttcacacatacgtaacaccaccctggggctggaggcatttgagtagctgacttatagagatacagtataagaggggcagaattagagaactggaaaatagattggaaccagattatggagggaattgaatgccgttgtaaaatacttgtattttattctgtgactggtacagagctaataaaagttcttagcaaaggaaggagtgatgattgggactgaagaagaatagcactcctaggctgggtgcgatggctaacacctgtaatctcagcactttgggaggccaaggtgggcggatcatgaggtcaggagttcaagaccatcctggccaacatggtgaaaccccatctgtactaaagatacaaaaaattagccaggcttggtggcgtgtgcctgtaatccaagctacttgggaggttgagaaaggagaatcgcttgaacttgggaggcggaggttgcagtgagccaagattgcgccattgcactccagcctgggcgacagggcgagactctatctcaaaaaaaacaaaaacaaaaacaaacaaacaaacaaaaaaaacaaaaacaaaaacaaaagaatagcactccttggccgggtgcggtggctcacgccggtaatcccagcactttgggaggttgaggcgggtggatcacgaggtcaggagttcgagacaagtctggccaacatagtaaaaccccatctctactaaagatacaaaaaaattagccaggtgtgggtgtgtgcctgtatcccagctactcgggaggctgaggcaggagaattgtgtgaacccaggaggcagaggttgcagtgcccgagattgcgccattgcactccagcccaggcgacagtgtgagtgagactccgtctcaaaaaaaaaaaataaagaaaaaaagaatagctctccttgatggtgtgatggcaatatgaaggatggattggagttggaagaaataaatagaaatagtgtagtaaaaaaatcatgggggctttgaaccaaggcagtgacaggtggggtaacaaactgaacagatgtgggagatgtttaagggttagaatcatgaggattctacacagaattctatgcagatagaaatgttcctatgtgagacagttaagatgaattgaagagaatatgaagttcaaggccttataatattgccattatcagaaatggtaaagccagaaaagagtgtaagtttaagagaatgtagggtatggaaatgttgacttgtttttaaaaacatgcaggaatttctctatgattctgacagcaaacttggccagtttataagattgtgttgcttcatagtagcttcaaatggttgagttttaaaaatagagtttagaatggctctctagtacctgaagtatgccctttcttagaaaaactttcttatcatcatgcctatttaaatggaaatttggaaagatttaaaaattaattttgggaatctcattgcattcatttaactgatcaaacagtaaagatttataatgacttaaatgttaattttagttcagtcattgacagctagcttacccttcttcttcccctatcctctacttttttccccagttctttgcctctgatgttttctggatctttttttgtttcttttttggagataggatttcactctgttacccaggctggagtccagtggcatgcttacagctcaccacagcctccacctcccaggctcaagcgatcctcccacctcagcctcccaaatagctgggactgcaggtgtgcacccccacccctggccaatttttatattttttgtagagatggggtttcaccatgttgcccaggcttttcttgaactcctgggctcaaggaatctgcccaccttggcctcccgaagtgctgggattacaggcatgagccattgcgcccagcctgttttctggatctctgtagtttattttttcttacatgaatcacagtattctgcttaaattctatatgcatgtctctttggtctgaaagtgaatttgatcaagagaaaaagatgagagttcttccttataggactctttaaaactgcagtgatgattcttttatatcactttgcctttaacacctgtttgaaactttcatgaccaccctcacatttggcgattctctagagcaggggtcctcagctggtccgtggcctgttaggaactggactgtgcaacaggatgcgaacggtgggccagcgagcattacccacctgagttccgcctcctgtgagatcagtggcagcattaggttgtcataggagtgtgaaccctattgtgaactgcacatgtgagggatctaggttgcgtgctctagaatccagttacaggtgtgtactgttctcccttatgtggaggtgggctgcatagaaagtacatagtatttctgcccaaagaaggctgctttaacatttaaaatccaggatttttattggggactggtcatgtaggcattctgcctgtgtagctagccacagctaccaaaattccaggctctcagaaggaaagtgtttactgtatgtaatcacattgtttacaaacaatctcagcaagctggtatagcagaattcagtgtcccaagtgggtaaaacagccttatcaacataagtaatattctaaaaaccaaattcacagatgctaaccaaggaccagtcttacaaacaggcccttctaaagattgtagcatcaggcctagctatgttaactctcaggtaaagctcctatgcctctttcccagttacaggctaccatattgccattctgtatttttgactctctgaaatgccatcttaacctttattatagcttaggtttcactggatcttaagatttttactttcctttctgattgtggcctcaatgaaggtcttcaaatgttagaaatagagaaaagtagatgtgcttttatataggtagtctttaaggaatggaatggcttctctctggacgtagaataaaaagaagccagagattctcttcctctgcccagtttaatgacagtcacagagcagtggcatttttcaaatgttttctttttctgtgacttttatatttacagttatttgtatatttctgcatatgtcttacagttaaatttttttatttttggttttagagcatttactgaggtttttagagcaaatgtaactttatgtttctcagtttcctctttttctgtatgttgattccctttgagtattaccatatctcctatcagcaagagcatttttaagacgtatagaacatgagtgagctccagaataatagcaaatcattctttgttggtggtaatggaatagtttcagtttctatgaccacgaaaagcctaaagaggaggtagcaaaagacatttgagaagattagaatatattttatcagcgtaaagattttttatatttacccacataactttttgtccccccccacccccctgtttttttctgtgagtattttcaaactgaaaggggagaggagaataaatcacagtggtattactatgacaacaaccttggcaccttaggggtaaggatcctgtcccttctgactggctaactgtagttgttgttacagttggtttaattctcctcacatcttaagatactgggactgcttctagactcattaggaaactggaagaatttgtataggaaggaaaatttgcatattcgtcaatgttatacagaggagaaatgttcaaattaatggcaggggaagattaagcaaataagtatttgtatatttcataaatatgtaaatatttaatttgtatatttcataaatttgttaatatttaaacaaatttaaaattttaagattttaattatttatataccacaaattaataaaccactttcaattaaattataatgttttcttatcgcgtgtatttttttattagaattcatctttttatgttagaattagaatttagaattttcatagtctgttttagtaagagcattggtaatacagtgtttctgtttttgttttaaagtgaggggctccaggagtttgaggctgcagtgagctgtgatggcaccaatgcactccagcctgggtgacagagcaagatcctgtgtctaaacaaaaaaaaacaaaacaaacaaacaaacaaaatgtgagggggaggttcttggatttcagctcttttatcttggattgatacatttcctgcagcatggtttaagctataagacaaaaaaagaagggctaaaagattcctctgtgttactaaagaattagcaagaacctggtgaggtattattaactgttttttctgtttttttcagatggcaaaattgaggcttaggatagtaatctgctgtaggtagcagcttgtgagtggcagggatggattttcttttttttcttctgcaacagctttattgaggtatgatttatacactaaaattcactcatgtaagagttcaatgatttaacttttttttttttgaggcagagtcttgctctgttgcctacgctggagtgcagtggcatgatctcggctcagcgcaacctccacctcccaggttcaaatgattctcgtgcctcagcctccttagtagctgggattacaggtgcacatcactatttttagtagaggtggggtttcaccatgtgagccaggctggtctctaactcctggccttaagtgatccgccctcctctgcctcccaaagtgctgggattacaggtgtgagccagcacacctggtctaaaaaaatttgtttttaagattaggggtcttgctatgttgtccaggctggagttgaactcctgaactcctgggctcaaagtatcctcccacctcagcttcccgagtagctgggacttacaagcatctgctacagcaccaggtctcaactcaatgtttttttttagtaaatctacagagttgtgtaaatattctcacaatctagttttagaactttttttttttttgagatgaagtcttgctctgtcacccaggctggagtgcagtggtgtaatcttggctcactgcaacctctaccttcctggttcaagcaattcccctgcctccgcctcctgagtaactgggattacaggtgcacgccaccacgcccagctaatttttttgtatttttagtagagacggggtttcaccatgttggccagactggtcccaaagtcctgacctcaggcaatctgcccgcctcagcctcccaaagtgttgagattacaggcgtgagccaccatgcctggccagaacatgttttcatcaccctaaaaagaaacctggtgttcatttgaggtcaatccttgttcttactctcagtctcagacaaccactgatttgctttctgtttctagatttgcattttgtggaaatttcatataaatggaattgtacaaaatgtagtctatttttcacttaggatactgtttttgagattcatccctgttgtcgcatgtcttggtagttaattctttttttttttttttttttttttttttgtgagacagagtctcactctttcgctcaggctggagtgcagtggcgtgatcttggctcactgcaacctccacctcccaggttcaagcgattcttctgcctccgcctcccaagtagctgggacgacaagcgtgtgccaccacacccggctaatttttgtgtttttagtagagacagggtttcgccatgttggtcaggttggtctcgaactcctgagctcaaagtgatctgcccatcttggcttcccagagtgttagggttataggcatgagccaccacgcccagctcattcttttttattgccaaataattattccattatatgaatataccacattttgtccatttaccggttgataaactattgaacatttccagtttttggctattatgaataatggtataaaaattcttgtacacatttttatgtcaaaggaaactgttgggtcatatgataagcctatattttaattctttcagaaactaccaaagtgttttccaaagtgactgtaccattttatattttaggaatagtgcatgaggcttgcagtttctttacatcctggccaatatctgttattgtcagtatttttgattatagccattctgatagacatttagtgtaatctcattatgctgttaatttgcatctccttaatgactaatgatgttgagcaactttttttttttttaaattattgtactttaagttctgggatacagtgcagaacgtgcaggtttgttacatagttatacacgtgccatggtggtttgctgcacccatcagcccatcatctacattagatatctcttctaatgctatccctcccctagtcccccactccccaacaggccccggtgtgtgatgtttccctccctgtgtccatatgttctcactgttaaagccccagttaatgagtgagaacatgcagtgtttggttttctgttcctgtgttagtttgctgacaatgatggtttccggcttcatccatgtccctgcaaaggacatgaactaatccttttttatggctgcatagtattccatggtatataggtgcctcattttcttaatccagtctatcattgatggacatttgggttggttccaagtctttgctgctgtgaacagtgctacaataaacatatgtgtgcatgtgtctttataatagaatgatttataatcctttgggtatatacccagtaatgggattgctgggtcaaatggtatttctagttctagatccttgaggaatcgccacactgtcttccgcaatggttgaactaatttacattcccatcaacagtgtaaaagctttcctgtttctccacatcctctctagcatctgttgtttgctgactttttaatgattgccattctaactggtgtgagatggtatcacactgtggttttgatttgcatttctctaatgaccagtgatgatgagcttcttttcatatatttgttggctacataaatgtcttcttttgagaagcgtctgttcatatctttagcctactttttgatggggttgtttttttcttgtaaatttgtttaagttcttcgtagattctagatattagccctttgtcagatggatagattgcaaaagtttctcccattctgtaggttgcctgttcactctgatggtagtttcttttgccgtgaagaagctctttagtttaattagatctcatttgtcaattttggcttctattgctattgcttttggtgttttagtcatgaagactttgcccatgcatatgtcctgaatggtatagcctaggttttcttctagagtttttatggttttaggtcttacgtttaagtttttaatccatttaagttaatttttgtataaggtgtaaggaaggggtccagtttcagttttctgcatatagctagccagttttcccaacaccatttattaaatagggaatcatttccccattgcttgtttttgtcaggtttttcaaagatcagatggttgtaggtgtgtggcattatttctgaggcctctgttctgttccattggtctatatatctgttttggtaccagtaccatgctgttttggttactgtagccttgtagtatagtttgaaatcaggtagcatgatgcttccagctttgttctttttacttaggattgtcttggctatatgggctcttttatggttccatatgaaatttaaagtagttttttctaattctgtgaagaaagtcaatggtagcttgatgggaatagcattgaatctataacttactttgggcggtgggctgttttcactatattaattcttcctatccatgagcgtgggatgtttttccatttgtttgtgttctctcttattcccttgtctctgataaaacagactttaaaccaacaaatatgagaaaagacaaagaaggccattacataatggtaaagggatcaatgcaacaagaagagctaactgtcctaaatatatttgcacccaatacaggagcacccagattcataaagcaagttcttagagaactacaaagagacttagactcccacacaataatagccggagacttaccgccccattatcaatattagacagatcagtgagacagaaaattaacaaggatattcaggacttgaactcagctctggaccacgcagacctaatagacatctggggaactctctaccccaaatcaacagaatatgccttcttctcagcagcacattgcactcattctaaaattgaccacataattggaagtaaaacactcctcagcaactgcaaaacaacagaaatcataacagtctctcagatcacagtgcaatcaaattagaactcaggattaagaaactcactcaaaaccgcacaactacatggaaactgaacaacccactcctgcatgactactgggtaaattacgaaattaaggcagaaataaagaagttctttgaaaccaatgagaacaaagtcacaatgtaccagaatctctgggacacagctaaagtagtgtttagagggaaatttatagcactaaatgcccacaggagaaagagggagagatctaaaatcgacaccctaacctcacaattaaaagaactagagaagcaagaggaaacaaattcaaaagctagcagaagacaagaaataactaagatcagagtagaactgaaggagatagagacacgaaaaacccttcaaaaaaatcattgaatccaggagctggttttttcaaaagattaacgaaacagatagaccactagccagactaataaagaagaaaagagagaagaatcaaagagacacagtaaaaaatgataaagaggatatcaccactgatcccacagaaatacaaactgccacagggaatactataaacacctctatgcaaataaactagaaaatttagaagaaatggataaattcctggacacatacaccctcccaagactaaaccaggaagaagtcaaatccctgaaaagaccaataaccagttctaaaattgagggagtaattaatagcctaccaaccaaaaagcccaggaccagatgcattcatagctgaattctaccagaggtacaaagaggagctggtaccattccttctgaaacttttccaaataatggaaaaagaggggttcctccctaactcgttttatgaggacagcatcatcctgatactaaaacctggcagagacacaacaaaaaaagaaaatttcaggccaatatccctgatgaatatcagtgcaaaaatctgcaataaaatactggcaaaccaaatccagcagcacatcaaaacgcatatccatcaagatcaatttggcttcatccctggaatgcaaggctggttcaacatatacaaatcgataaatgtaatccatcatataaatagaaccaatgacaaaaaccacatgattgtctcaatacatgcagaaaaggcctttgataaaattcaataccgcttcatgctaaaatctctcaataaactagatattgatggaatgtatctcataataataagagctatttatgacagacccacagtcagtatcatactgcatgggcaaaagctggaaacattccctttgaaaaccagcacaagtgtgtctcctctcaccactcctattcaacatagtattggaaattctgtccagtgcaataaggcaagagaaagaaataaactgtattcaaataggaagagaggaagtcaaattgtctctgtttgcagatgacatgattgtatatttagaaaatcccattgtctcagcctaaaatctccttaagctgataagcaacttcagtgaagtctcaggatacaaaatcagtgtgcaaaaatcacaagcattcctatacaccaatagtagacaaacagccaaatcatgagtgaactcccattcacaattgctacaaagagaataaaatacttaggaatccaacttacgagggatgtgaaggacatcttcaaggagaactacaaactgttgagcaatttttatgtgctgattatccatttgtatatcttcttttgtgaaatatctattcatacatttttgcccaatttttattttggtaatttgttgttttattgagttataagagtatttatggagacaaattccttattagatatatgatttacaaatatcttctcctaatgtatgacttgagttttcattttcttaatgaagagcagaagtttttcattttgttaaattcagttatcaactttttttcttgtatagattctgtttctggtatcaaatttaagaaaactttgcctcctccaaggtcatagaaattttttcctttgtttcgttcttgaacaagagtcagcaaattttagcctgtgaaccccatctggcccacagcctacttttgtaaataaagttttatttaaacatagccatacttttgtatttacatattgtctatgcctgctttttctctacctgaactgttgagcagttgctatactgtactgcccagaaaacttgaaatacttaatggcccctttcaaaaaatgtttgctaacccctgttctagaagtgttacagttttagctcttatagttctaggatccaattttaattaagttttgcatatggtgtgaagcaaagagacaagttcattattatttttatttttattttggtgtatggatatgcagttgtcctagtactatttgttaaaaactctcctatatgttagaagttattttcttctcgctgctttcacgatttttttcttgccaggcacggtggctcacgcctgtaatcccagcactttgggaggctgaggcgggcggatcacgaggtcaggagatcgagaccatcctggctaacacggtgaaaccccgtctctactaaaaatacaaaaaattagctgggcgaggtggcgggcgcctgtagtcccagctactcgggaggctgaggcaggagagtggtgtgaaccccggggggcggagcctacagtgagctgagatctcgccactgcactccagcctgggcgacagcgagactccgtctcaaaaaaaaaaaaaaaaaaaaaaaaagatttttttcttgtgttttgttttcagctgtttgattatgaagtatctgggtgaggatctctttgtgcttatcatactttggatttgttgaatttcttagatctgtaggttaatgttttttcatgagatttggaatgttttcagcagttatttcttgtaatatttttactgttccctttctgaagttcccattatatacatgctggtatgcttgatgttgtttacaagtctccaatgctctgttctttttctctgttctgattggttaatttctttatctgtaatttcacagactgtttcctatataatatcaaatctgctcttcagaccatctggtgaactcatttgaattttttatttcggttactattcaactctaaaatttccacttggttctttttaatagtttgcatttatttctttgttgatattccctatttagttatatcatcataactttgagcatggcttcctgtagttctttgaatatataataactcctttgaagtttttgtctgctaaatccaatatctgctcttactcagatacaacttctgctggctgcttatttttcccgccgaatatgggtcatagtttgctgtttctttgcatgacttataatttcttttggaactggacattttgtgtagtatgttatagtaactttggattcggtttttactcattttttcccttgcaggttgtatttatttatttattaggaactttcatgaacttcaactgcagaatctgtctctcccactatgtgtggtcacttatgtgtctccccagcttttaaaacttcttaatttttaattttaagcttggctttgtagggttcccacctgcaattccttaatttagtgcttagctaattattggttgaaggctgtacctaaacaccttgagccagaaagactttcaccctctgctgggagattgtatggaggctgtgaagggaggatcacttgggctcagagtttgaagctagcctgggcagcatagtgagaccccatttctcattaaaagaaagaatcaactaagtatagtctgttttcatgtttgtttcttttactttttattatgttgtcttagacctaagaccctgtgcacgtacccaaattttctgttagccaggcgtgtgtggagagctaggtctctcaggtttccagcttcccctgtgcatacgctgccagtctctcagcctgcgttttgtgtggagcttaggaccttatgggagtcccctgtacatgcgtgcagcctcctagtcagccagtgttgtgtggagggcataggtctctcttcaggatgtgtggaaaatttatcaagtctctctatggctgtgccatttctaggatctgtctattaaatttctagttagtcctcaggtttctggctcaccccaacaacagcaatctcggactaagaaatctgcaggcttttctgtttcctactgagtgtgggttttccactctctgctccaagtcaaagtcatcccctttttgcaatgaaggtgctgttccttgatggaacttatacctcagtggagctagggtaggggatggaggcagctcctggtaagatgccaggtttccattgttgttaccaagaagttctgtagtttttcatgaacatgctcttctcattgtttttgtttgtttgcttgtttgtttttgcctttagttgatttccataacacaaagatggttgtttttgacgcttttatctagttttataattgctttttgggggtgagattttgtattccttcactggaagttcaacttcagaacttggattttaaatcctagtagtattacatttcaaagctaaatgctcttttctctaattcatgagtatttgtctgtggagatagagaacaagtaattttttaaaagagagatgacagaggggtggataaatgagcctcgattcaagtcctaggtttctacagaggatagaattttatacctccttacagatagatttgtaagctcaaactgaggttaattgaagggattaatggctcttgtggagagtagacatgtgttgtttattcagagtgagccaactcttgtgacgaagtacctttcctatagtgttcttcacttcataacaattttatgaagtaagtattgtaattatgatcattttacagatacggaaatatatttacaattcgggaacttacctatgctctgaacatttgtatgtggtggggatggcacttgaacccatttcttctggtttctccttgttctttatactctgtataactgtttcccaatcatatcataattactcacagacactttgattatcttaatgtatttttttatgtaggtagtagttgaggttagaataattaattcttttctttcaattgacaatcagtcttaactaattgaagagcccctattcagtcagggagttatttagcaaactggtaacagttagagaaagagatcctgtggcagcttcctctgccagcttcctttttttctcttactccatagatgcagattctgcccaagaagcccctgcattgcagagggactggagatctgtatgatctgtttatttcgcaattgacagggtaagggggccttatgggggaggtgcttgggtgccctaaatttagctttatgcagctgggctaacatttatttggggattatttaaacttagtatttttaaaaacttttgtgaattttgtttgtcctacatcagttaagtgccagattatcatattaaaaagcatttattataatggtgatttttttaaaaaggtcctgttgagaacaaatcagacaaacatgattcatgcttctaaaataccaaatctgggatcatttagaatataaataatattgaatatatataagtaaaatttcacaataacatttttaaaaaaggttttgaatgaacatctgtttctatagctcatcatagttattctttattaatctactttgtttcttttccataaatctgtcaatctgtagagtgaaaaagggacttgtggatatgccataaacattgtgggtgggtgtggtgtctttttctgctgctagaaattaaaacttacttcctttaattctttgtctattctagatgccaatgaaatttgagttgtatttcagactgtcttgtatctgatcattaggataagtgtaaaagtgcagttgataaaacttacgggagccaagattaagtttttaggtctcacttggcaggtttatagagcaagtgccagaaatgatggtttttataataggataggattaaaataggtgaggaagagtttaatggtcttttataatcacagaaggatttggcagatgactgtagccttgataagtacttgaaaagaattgaattggtgctcttctgatgggcttgtttttattttttgagatgttattatacctggtagtaaaatagctttttttacctaaagaggtagtatatatttctgtagtttaaatggatatttttagtattctgtatgactcatatttttaatcgtacccttgtaccctttaaacatttaatttatggattttaagaattcatcaataataattacatatgttatccttaccactattaatacatattccactttctaatgccaacacatttggaaaactttcatttaagcatcttaaatgacattttttttttttctgttttctttaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtaagttctagattttaacatatcatggtagatgttatatacttctggttaaaggtatcttttcattctaagctctgattttcagttttttatcactttccttggaaagttttacttctggcagcagtgtttaaaagtgaataaaaaatcttttgatcctttaaaaaggatcagattacaatagtggattatgggtacatttccaaaggcgactggtataattggattcacactgtgaaggcatccttgtttagacacttatttagtgggagttaagatcttttaacctcatttccaagtaggtgtgtatggtagattctctgaagttagttttggtggataaatccaatgttctttagagtatagaagagcactgtgtgctgtgccagtccttttccacatttccttttttgtaattagtcttttttttttttcccctttggtgcttagtttttactcacaattgccatcagtttaaagctaccctccaaagattataaaatattggctattaagcactgtggtcatcattggtaatgtttttataagggtaaggactcttgagtgattttttgattattgtaagagcaaggacacgtcacagtgagtacgttgtaagagaagtgagctgtttgtggatgcctcttttagtaaacgttgcttctacagtctttggatgcagtttgctttcctttatccattactgtcccagaatatttctaagttttgttcgttttaggacatctctttgacctattaatttattggtttaagatgccaatatctgttcatttatcacttatttctttgattataaggaaacctaaaatgtaagaccataatttttaagatacaacgctagaatagccaggagaacatccttagtgaaatatagggagccatggcattttatgtgtcttacccactgattgccagaattgattcaacatttatctggcctgcttgggctggtgtcttctcttgcttctatctctgaatggccttttcaaagttgagatctcagttcaagagaactatcttttgtaatggtacagattagttttttgcataaggtacttagcctcaactggagtgattttactctcaggggcatttgataattcctgaagacagttttgatcaccacaactgggatatggtttggagggtggcaatactaatggtatctaatgagtagagtccagggtagctgctaaataaacatcctgcagtggcacaggatggctcccacatcagagaattaccaggcccaaaatgtcagcagtgctgaggttgggaaacccagatttttaggatatgcaggtagttgcacttcctttccaaccccccagagaagctctcagggttcttcttctttttttaaatctgtttttaatattcagggttctttaattactgattttattggttagctggtttgctacctttggcagaagttacattttatggatataagtatactacttagatctgaaggctaggtagatgcttaaaaggagtgcctttctgtggaattttgaaatgtaataagtgaccttgaaaacttaagtatcattactgcaaaacagcatattttccttaatattgtgaatttgtgttggtaacaaagcatgtctgtatgttttgaaaattaaaattcttgaagcaagtgtcccacacctccttcatttttaaggctcttattaatcacttgatttacataattagttcccttgatattattttttagaacctgggctttctctctaggttggcaacctgtgcaactgtaacataaattcacataaaacgtcagtaaacatttcaatattgctcttttctgtggaatcatcctttttacctcattaataaagaattctaaagtaaccaaagcctagtccactgctatatgtaactacagtggctgagagagaaacataaatttgttttaccttctacctagattcttagaaaattattgaggttgttttgtctcctgatttcttggaaattttggtatctaaattgtaagataggatttccaggtgatagttacaaaaaagagctcaaaaattttaaagactcataaataatagttataagaattatccagagactaaaacattttttagatttatgtttggtgtttaagtagtagaacttttcaagtgttcattttttagtatcatcatcattaataatactcattaaatgttttctttgtacttatggaaagcaccgtgctactacttattgagaaatatgttggggttctggggataagtgaaaggtgtaacatagataatattccaaaattgatagtcttttcactaccacagtaattcttgtaaagtgagatacattttctcttttgcatgctgactaaagtattatgaattattgaccagttatgggttaagctatctaaagaattaagtttcatgtttctcacattcatattgtagtggcgatgggtatctttcctaaattagtaagtgtgccatattatcatctcaaaaattcagctttttctcatgaagataatacttaatggtttttctttctttttaaagagatactatacagcttgatttttattatatagaagcaatcataacactgacttctaaatttcacaggagggattcagttcctcatgcatgcagaggtcttaaatggttcattgagtttcctcttaacacactataaatacctgaattttttggggaaaaaaattattgcagtacacttgaaaaattactcagctacacacagtggaagtttctttgttttgattattagattactggcagtgactacactgttcatttctagtcattggttctctctatattgtgcctaccttttgcagaaagtgaagtgaaaaccttggtgatagagatattccagatttttatctgtaaattggaaagatttttcttgttgaccttatttgttagccagtgttctttataaacatgatttattttcttaaatttattttactttaaagatgttcatctttcagatgccttgtagcttttatttagacttgaaaagagacattagagaaataaaggtagacgtactgaagtactctcaagttttctttctagttgagttaagccaagggagagacaggaacctagattccattatcccccttctttcaatcccctcatttgagttccccaaaaagaaaccctgcatttcagttcctgccttttattgcatcaccagtcttgtacatatagaaatgccagattatatttctcaggcaacacttaaaatagtttcacctcatttcatcctttctgttactagcaggaagtagattaagtgaaaagacatttgccactagtctgtgtgctttaccatggttaaataaattgttccaatactttttgtgcttattaagttctatatcctataggatggctccgtatgagagaattttgtctggacctattttaattttttcagttagtagaattttcattctgttttctcaagtttcagttttggccttcttcatatatgtgattgatatttgtgttttcctgaccttcctgaaatttatatttctaaatttagattgttggcagctttcattaacgtaattttcacttctaagaagtttctaaatgaaattggatttagtgaaaatatatttttcaaaagtggagttatgaaccgggtatggtagtttgtgcctatagtcctagctatgtgggaggctgaggcaggaggattacttgaatctagcctggagaacaagtgagacctcatctctaacaaaaaataaacaaaaagtaaaagtggacttcatgctttatttgatttgccttttatggtggttttacaaatcagtttagataagtttacttggtgaatatttatgacatatatttttttaaatatgagaagtttactgtagtcttttcagcaattttgaatttttatgcatacatttatatttgttttggtttacataactacctttttataaatacataccacttattaaaagtggcattcccctaaatatttatgaaattgataacattcagatttcttctttactgtatattaatgtgattattcatgcatactcttcctttctgtcagtctcttgggtataaggctgttgctattttctaaatagttaaataggtttgagtgtaagttagctaattcttaaaatgtaccttaaccaagccatcatatttgtcttctcaaatatttgtacatgcagattttacatatttagtttttgactttttgcagatttgagataaggctaatacttatacattagcacttcagattgaaagcatgatcgtatttagcttttaaaagagattaccttatttgatgctacttacataatatttcctttatgaaatacattttttctttggtagtgatttcaattatgaatgtccccaggttgggtccttagtatagaatggcctaataatttatctcacaaggttgttgtgaggtttaacttaaatatttgaaagtggcttagcatataaacgatgtgattaagtaaatgtgtgacagtataatttttattttatgtatctgaaaatctatcttattgactgatcttttgggggctttatagatcaactttccaaggtcattatttatttttgcagttcagtgcatagcttaatgttgaggtatttactgttcttttaccttttgttttaaggtacttaaaaagtagcattggttcttgtaccattcattgttatgtttgtcctcattagttgattgttgtgtgttaaacagacatccctggagcttattctccacactctgtgaatccactcattaatcaccagtcacctttggagatgggaaaattacttacctgtatttctttttctcagaaagcgtgctctggaatggattcacaaatgagctaccctccttccctcaaagagtaaggtttctgctttacaggatttttttcttgggttatttttcctctcatcttttgaatttgaaaagaactgagggaaggcacctgaagaaactactgacatactcactaggggagttccaaagcttgtgctgcccctaggggcagtgtcaatggctcttaaagctagaaagctcatacttggagttgaaacaggggctcaaagaatccattttcccagtgtaccttctgaaaggataagtttcaggtaagtaattttctcttactatgtgatacgctttattcatacttaaaaagtacaaaagtccagttctccaggtacatgggcaattgtatttgtttatagtttagattcataacctttactgaatgtcagaaacacaaaaacttataaaaataaaatatatttgctcttgagatacatataatttattttaagtcaataatacatttttagttaaaggtgtatttatgatcagtttattgtacttgtgctataattttctttattattaaataaaattttgagacacttttaaaataataaaaaccaaaaagtggtattttaaactcagtttctaaatgatgattgactaaagttgtgtgtgtgtatgcagacatacgtaaatacacacatacatataggctatgatgatgacaactatttacttcaaattagatgccttctgtatgtatattgaccagaatacattgctcaagtgatttttaaatatttgtataatttttaaaaattaccatgagacgatttgagctgttgcaactaaaatatttattcagtgtagtagctatatgtagtgtggatttagctacttaatcgaaacattctttagagtccttcaaatatttatagtcagtttttcagttactaaatatgaggtggctactaaagagtaacaaaaagtagatggcatttactgccattggctctctgtgcatttttgcattctcattaaatcccatgccgatccagtattttaaagtatttcaaacatttcctctttttttccttcagaagcagtttttaaaaagtgaaagttacatagaaaatggtccatatgaacaagatagcaatttaaagtatagacttttcacttactgttaagtctgggttgaccaacttcagccatttggaacagcaactctttacttggaattaagcagaaaagacttttgagtagcaaacgactatcatgtagtatatgcgtttttctctgaacctgggagtagcagtagattatgtcccagtttcagggcttactgatagtagccaaaactaacagctatttccagaagcagggaaaagagaatgtattagtgtaaacctaaagcagttcaggttcaaagaattgaggtgtatactaccttgatttcctccaagaatattgttcttatagtgagagtgagtcagaatattcttgtctaaggtgttcatttgtttcagaaagattttggacagctttgtcaaaataactttgaaatagaagtaaaaatttagtatcaaatgaattgaatcgataaattattataactgcactttagatttggcactgagcagccttctcacagccacctggcaatgagaaaaatagtgtcaggctgggtgtggtggctcacgcctgtaatcccagcactttgggaggccaaggcaggtggatcactttaggtcaggagtttgagaccagcctggccaacatggtgaaaccccatctttactaaagatacaaaaagtagctggatgtggtggcacatgcctgtagtcccagctactcgggaggttgaggcaggagaatcacttgaacccgggaggcagaggttgcagtgagctgagattgcaccactgcactctagcctgggcaacagggtgagactccatcttaaaaaaaagaaaaaaagaaaaatagtgtcaattatatagttattagataattctcattgttatgtatgaagtattaatatatacattctttacagaaaaataaagctataccttactctaaattttaaaagaaatgtttaatgaattatcaatatagaggcattgaacaataaattatcattgttttaagaattttttttttagttcaaagactatagttgatctcatagctaaggtaacatgcagtaatctttattgttttattcaggaagcagatattgtttcagtccctgttgcccaattctaggatatcatcagttaagttataagatgcaatattgagtgaataatggctcttgggagagaataaggactgctacattgagtaattatgttactgtatacgaaaagttaaaatgtgaacattaaggaaatatgacatattttagaaaggtgaccatcaaaggtgatcagtatcaacaaatgaatgaagtgtttcagttctatgatgtgtggtttttcagaaaaggacatcaaagagggttttataattttgcactgcccatcatttacataatttttttagtaagatgaacagaaaacttaaaaatcttaattatctagccgaagagttccatgtcttcaggtgtgagggtggtaactggatatatcaacattgctctgaacgtgaagcacaagacacatgatgtgtgtacatgatttgtatggtctaattcctttagaaatgcattttggtcaatctttaacattaaggaaatacaaaagtaatgagttcttagaaaaaaggcactgctaaaagatttaggtgtatctgaaatacgttgcagtcagttgagtaatactccccataattagttaagaaaatttttaacttgattttcatgtaactagtaggaaacagaatttattttctgagacttttgttttctgttttctctttaagcttctttcattttaccttctctattctttggagaatagccaaaacattgaatgttctatgcttataatcttattgagattttatgtcagggtaggaatatttattatatttatattatatttacccttttgtgtattctgttcacgttgcataaggcacttgtattgatccttttccaagttgtgcaaaaatgagataatttttaaaaaatttacttcataaaagtcacacaagtcacagtatttgcgacctcatggtttttttttttttcccccgtaatagagatcaaaactttgtacagcaaaagctaaggcttttagtgatttgttataccaagatagttttcttaaaccaaatattcttaagtaatattctttgggtttactttccaatatagactgataaaatgtttaacaatgcttctaacttttaagctattttgtttccttaatcttgtatttctggtgattttaaggtttctacaatttgaaacagttcttaacatcataaaacattggtgatatcatttctttattaccttcccaaatgtgccttttatttttatgtacaagggctcttgggaatgattctctcagaggcttaagctgtgctttgcctttcatgagaactgaaattatttggtaagcgcttgctttctttttagcttctaatttttccctattttattttgtacatgatatttgtttcaaggtcaaaggttccgttacagttactatgatgaatcccagggggagatttatagatccattgaacatctagataaaatggtaagtctttcaggtgtgggattttaatgctctaaggctttttctttaatttcagattagtaattcaagacttaacatgttgaaataatatattttttccctatctttaaatgtacaaaatgcaatgtgtcatcatataaatactgactataagaataatccctattctagtaggaatttccgtcatcataattttgtttgattaatgagaatatttaagaataatatatacggatttaaaatactttctagagaagtactttagctttaggaacagtaagatactaataccattatttactgttaagcagtaataaccatagcagatgatgggataccttgactctaattcctgtttgtttcacgactacctgaaatatttttttttgagtccttcttttgactccttctgaacagcattgttgttttttaaaatttattaaataacttagtatatttttagttttgatagcagaccaaattactgttcttaagtgatgatgaagattttatgaattagctaataaaaatctgtattctgttggaggaattatatgtaaacttgaagtaaataacctgaaaattttagactgaaagtctttattttttaaattattgcccctttacctctggaaataaaagacatcatagccttatgatgacagtgtgcaggaattccaatatacacaaaatgtagctaacttgaatcttgtctgctatgctgaagggatttatacatatactttattttaaaatttaaaatttcaggcatgtttgttttgttttgttaatttatttttattatttccttggaccagcagtttgacctgacagaggcatatttattttggaactactttttttttccttcaaatttttagaagctctcaaaatctaaaattcagtggaattaatattttaaacataataaactcacatcattgatatatttctgtaaaatatcctgtaaatcagattgttatatatctaatttcatttttgttttgatttgcatttcccattgatcttaagcatgcatattaagatatttcttttttcctttttttaagagacagggactcattccgttactgaggctggagtgcagtggcacatcatagctccctgcaacctggaattcctgggcttaagcaatctcctgccttagcctcctgagtagctgggactataggcacatgccaccatacccaactaatatttatttatttatttatttatttagagagaaggtctcactctgtggcccaggctggcgtgcagtggtgtgatcttggcttactgtagcctctacttcccgggctcaagcgattctcccacctcagcctcctgagtagctgggacacaggcgcctaccaccaagcccatctaatttttgtattttttgtaaagacagggtttcaccatgttgcccaggctggtctcagactcctgagcagaagtgatctgccagcctcagcctctcaaaagtcctgggattacaggcatgtgacaccgcacccagcttttttcttttcttttctttttttgtagagacaaggtcttgctttattgcccaggctagttttgaacacttggcttcaagcaaccctcctgcctcccagagtgctgggattacaggtgtgagctgccgcacttggcacatattaagacttgaactttatggcctggagccttcaggtatctattaaaaagagctataaaaaaagcataagaaaacaaaattatttttacagatgcaaataatttgtttttttctcttcatttgtccttttgctctttttacaaattcttagtgtattgtcttgtttttgggccatttggatttttctttttttcctttttctgttttttttttttttttttttttttaaagacaggctctcactctatcacctaggctggagtgtagtagcaccatcatggctcactgctgcctcaacctcccaggctcaggcagtcctcctacctcagtctcctgagtggccgggagcacagatgcataccaccacacctggctaatttttttttgtagttttttgtagagacgaggtttcgccatgttgcccagactggtctggaactcctgagatcaagtgatccaccctccttggcctcccaaagtgatgaggttacaggcatgagccactgcacctggcctggatttttcttaaaaggaatttcaattcgttgttctaaacacagaatttttaaatataattatattcttacctagctaaggagtacagtagatgttgatcctactgtctttttttcttgaagtgccatggtagtcataatattttttcttttccttcttttctttctttttttatttttttgtgagacagtgtctccctctgtcacccaggctggagtgcagtggcacaatcacagttcactgcagcctcagcctgctgggcttaaacagtcctcccacttcagccacccaagtagctgggactatagacatttaccaccacgcccggctaattatttttatttttattttttagagatggggtttcgccatgttgtctaagctgatgatacttattttaattttttaaataacacaaataattttaggatttactcataaatagtattaaatatagcagaacagctctaacttgctctctatgaccactgacagattattttaatactctagttttcatttccttatctggaagaagatagacttggactaaatggtctctaaattgtctttaaattctgtcagcttgtaagtcttcagtttgttcaaatcagctctaccaatgtgttaagccttatgcatatgttttagtacaagattatttggtttaaagtagatcaaatattttagtaaggaatctggatttgaatgtataaatagaatatatcatgtagtatattttattaaagccaaatgtaatgaatgtaaagttggttacttagtgtgtttatcatgtttaaacttaccttagttgctactttaaatccaattattgtccaatacttttacctttagaattttatttggattttaatgtattaccttctttttggcttcctgatgttttcatttcagttgtttaactctcctttgacttctagtctttttattctgaggtttagttctcagttgcctcagaaaactttttctggctttttccatatagcaaatgattaatgattgtcaaagcaaatggttaatgggtatctgctatatgtccggtactctgtgcagtattgaggacataaagaagagaaaacatagtccgtgacttaatggagtccagtggttgaacatacttacaaagaagccattacaatatagagagctgagagacatttaggaggtagaatgaaaaggactttagggattaattaggtgtgtcatgttaagggagtggtgggatgtgggatgatttctggcttccttgtgtacatagatgctgatactcactaatacagggaatataagagggacagatttaaggaaaaagatgagttcagtcttatacatgggttttgtgttatgtttagaactgcactttttgatactgtagccaccagtcacatgtatttattgagtatttgaagtgtggttatacaacttgaaatatactgtaagtgtaaaatatacactggattttgaacatgtagtatgaaaagaacaaaaatatctcagaaatctatcttgattatattataaaatgatactgccagattgtgtttaataaaatatcttaaaattaattttacctgtttattttttaaatatggctataataaattttaaaattacatatatggcctgcattatatttttattggacagtactggtttagaacatgaaggtaggtctggatggagataaacattttgaaattattggtgtatgaggagtggatgggaagaaaggatgttaatgccattgtttagagagtcaatctccagagagagtataaggagtaggaacaaagggggagttagatcagatggacataccagcattaagtggaagaggagataaagcagagccagtagagttctgcttagagagaactgagaatgagcaatatcacagagaggatgagctttatttagcaaagagggaggaagagtatcaaatgctgcacagaggtgaattaagaaccttgcaagagcagtttcagtggaatcagcttagaatctaaattggaatgaagaggcaaaaaccaaatgtgaaaaattattctctactagtttgagtatgacagaaaggagcaatgtttaaatgttaactgatttggtagatgacgagatccagggaaacacagtcacaggaggagtttttaaagatggaaactatgagattacttcagaatttccagtaacattaatccctaatttgaggtattggagagatttgacttaagattatatcagctatatgattctcgtttctcctcggtttaacctttcttgtgttacattttattcatttaggaaagaatctctaaggaggaatggctgcatatatgtgaaatataaattattaatggtatgcatgtaaattttcccgtcattaaaattgtctttttttggttaggtaaccatacagaaaataattttgaaagatacctcagtactaaaaattttcaaagtaaataaagtcttcctggacatggtctttagcaagtttgtactaaattttatgaaagtaatgctttttgcaccaaaaatataaaagaactcctgccagaagcacgtgctcaaacaccgtacataatttccacttggatgtcttataaacagctcatactaaacatattccaaacggaattcctgattttcttcccaccaagacctgttctactcataggctttcttaattcaaatgatggtggtcctatccttccactttcctaactggtcttcttagacctaccctggtattcttcagtctcaggtggcttaaagtaggaaccaaagcaattattttaaaatctaaatcagatcatgttactcttctgccccatatctcctgtaaaattgccccctttcagtcagaataaaagccagtgtctttacagtgggtagacaaaaaggaccaacatgatttgcagcccccaaatgttaagagccctccattttcttacttttactcttccttcactctaccgtggacacactaatctccttactgtgccttgataatgtcatgtatctgcctagcttagggcgtttgcccgttttgcttagctctcaccttctcactggggccttctgactactctatttaattttgcatcctacatcctacccttgcagcattcccagtccaccgtaccctgttccactttttcttctaaaaaactaaatacttaattacatttctgtcaatcaggatatttgttttgttctccgatgtatacaaagtgcctagaatagtgattagaatataagtaggtggtcaatacatatttttcaaatgaataaattaatggatataatcttcctgtacgcagtttaaaaccatgactttcctaactgtaacatgtaaaggaaataaaaggaatttataataaatatatatttaagaatgtaaatgcccagtcacaactaaattagaaggtacaatgaagtatttaaatatttatgaatagtattattaatgtaaaaacagcttcaaatacacacttacacacgtatgtattagtgactgaaattactaagtgccattgctagtgacttgattttccaaaatggtgaacaattcttagtaaacttgtaaacaaaaccagtacagtcttccctcactttacatgatagttttattcctgggaaactcattgtatattaaaatcaatgcaaaacttatttctgtttgtatatgaagtggaattaatgtatagataattaaggctgtagatattctgtagtcttatggatggagaacagtctttgtgtatgaaactgtcttgtgtcagcatccctggaatcccactgagtcccaatagcatcttcaaattattgtgacagccaaaaagcgtgcatcattttccattagcctccttggatgaacagctgttcattggccttaccctgctgtatttttattctaggtatttattactgcatgacttactcatttgttgatttgtcttggggttatctccctcactggattacgtaagcttcatgagaacagggactttgtccatttcccatcctagtgcctgtcagtgggcacacaatatatacagttgttgaatgagtgctggataaatggatggggagggtggtgagaagtgaaacttgaagactccagaacagctatcttgaaggatcttacatagggaagtgataaagttggttttgtatttgaatagatcatatggctgcagtgtagcaaatgggttggaaggaggctggaagagataacgtgtagaccagttaggtagtccagatgagaaactatggtaatttagacagtgggtagggtgatggtggtagaagagagggacagaaatgtatatattcagtacatttaggagacaaattgatgatgggacttggaggtggattgagcttggggggtcaaggaaatgtcaaggatgactcctaaatttttggctatgctgctggttcgatggttgcattatttatttaggccataaggaccaaaatgtttttggtgggggtggggcaggaagataataaattctattagggatatgttatgtttgctgttgcctttaagacatctaagtagagatgtcaattaggtagacatttggattttcattttgccaattatttttgagtacatatacatcctgaggtgttggtggagatacagcagtaagcaaacatggttcttgctgtcataaaacttctaattggaggagatatgtgttaattttaaaaggtaaggaaatatattaattagtttcaagtaggaatgtgtgcagaaaatacctaaaaaggtaaatgatggtaaatgattggaggctgttttggattgagtggtctgagaaagactaccttgaggatgaaaattaaagtgagttctgaatgataagaaagcaaatcaagtaaagatcagcgggaagagcattttagacaggagaagttgccagtgcaaagaccttaagattggaaagaagctggtgtgttagaagaaaaggaaaaagcctgtgttgtgggagtatggtgtgtaagagtaagaagagtggtgtgtataaaagaggcagggagctgataatatagggtaataattgaaggtaagaactttatataagtacaataggaagtgaaatgatataatttgaattatttttaaggtcactgtggtagttgtgtggcaaatggattacacaggagggtcagaggtagcaacaatggggctgggggcggtggctcatgcctgtaatcccagcagtttggggggccgaggcgagcagatcacttgaggtcaggagtttgagaccagcctagccaacatgacgaaaccccctttctcctaaaaatacaaaaattagtcgggcatggtggtgcatgcctgtagtcccagctactcgggaggctgaggcaggagaatcgcttaaacctggtaggtggaggttacagtgagccgagattgcaccactgcactccagctctggggacagagctgagactctgtctcaaaaagaaaaaaaataaaggaagtagcaacaatgggccattggcagaagttcaagggagagatgatagtaacttggactgtggtgatgttggtggaggtagaatgaagtggatggaggtcagatcttttcagaaataagagtcaaaaggactttgctaatgggttgactattttggtttggaactcaggaaggctttcaattggactagagatgtaagtttgggaggtctcagtagatcattaaagccaggacagagatgagattgcctactatagtaatcattaaccttatcattacaacagaactcacttgtggtactttgttgaaatttgctgagaccctgtctcaaaaaagaaaaaagggaataaattgtacagtagaaccacttagcccaggttgacttctaagtttgcatctgatttaccttactttagatatcccaaattactggaacataattttaaaaattttatttaaataccctggaatatgatttctgaataaatattgagtatttgcttcatattaatatgcttgaatttaatatttgattttaacatttggacttggagtttatttctgtggtccatttgttgagatatatttatttatatatagaatttttaaatggctcataagtgttctattttattagtatattgttgattcaacttataagtcaattctgggagttagaatacatgggtcaaaataataagacccgtgtatggttagctctagacataaacttaggtgtgtttatattacctatgtatatatatatgtacacttgctgttaggcagacttaaatattgtattgtcttaattgattaatcagatggtgaatgtacttttgcatatttattttctaagagattattttatattataaataatttaaatcatttgagaaccaatatcttagttttcatatgtgatcttttcagacaaaatgtacttggatggttctctgtataagcattataaaaatgttaattttgaattccaataatatacattttggaagtttgatagagtaaaaagaaactaagtataaaattttagattacatctgttcaaaattagcatgttaattaagttttggtcctttttaactgaaaactattactaaatatagttattacaaggctagaaaataaaactaagttgcaaaagaaaaatagctattcttattgcaaaatgtttatatttctagcacttgaatatcttagaaattaattatgtgaaaaaacacataaaatataggagaacaaactaccgaatgtagttgggaaaaactatgtaactgtagcataggatatctaaactctgaaagtcttgtaattttattggctatagaccagtgtttttggtaattagtgctttgcaatgtcaataattactgtgactaaagcagaacctagttggagatactgatcttgtaaactttacttacttgaaatattagtcatagttattcatatgagatggtcataggttatcatttttattatactactttttttggtgtagaccagtgtttcattatggacattggcaaattatgattcggcaaggataatctgaaaatgtcattgtattcatctgttataacttctttttcttttaaatttatcagttacttcacttaatttgaatgtgaactacttttcttccttcctactgttttaaaagtgaaaattgttccttcgtcacctcatacttctttctcttgaacctaagccaatagctttttagtaagttttataacatcacttataagatagccatttattagtacattacttagcactgctatttttaaggtgagttttttccataaaactttcactgttactattttatcttgatacctcttaaagaaactagaatatttccttttcctaccccatgtcactaaatgtatacttatctgcaaatataaatatatatcctttaaactataaacccacaaatctaatgatttgataatatggtgttaattatgtggttggaattaaaagatatgattctggtttttatttcgtaagtgcctctaaaatgttttgctactcctttgcatttgttacttttgggagagatttccttctgggtgataatttttagattgtcattttattaaatataggtaaacttttttaaagagggaagataatttgttgtcttatcagggtcctgaatctgagctttgtcagttaatactgcctatttagtttggggttgccacttggaatttgacatcacaaatattcactgattacttgaagagtcaacacaatgatagactggctcaccccctaaatttagggagttagctttcaatttgtggatttgtttctgaaacttaaattcctcagaaacctgtatccttgatggatgggcttttggtgtttataatgtctgccttatatcttagcgctgaatgggtagtatagtgacccatttcactcctccacattaggttaagtttatgtgaacaatcaaattttcactatactaggccttaggaagctctcattgcctggactttagacttactgatcatatcttctactcttttaagaaataaaacagttaattcagcctaattggggaaggatattctttttcatcttcttggacttttgccaacagcattgaactagcatttctatctttttggaattttcctaatagtaatctcatagctgttaacataaaaacataggtatatctagaagtgtatttgccagtatcctgtattagttaataatgttccatttctaaattttatcattattgcttttgtttgcatacttcatgaatttttcaattagagaggttcacttatgagaaaagccttagttttcccatctttccttataaagaggcatacctcttaaaccatcacttgtgtcagctgagtataattgaattaatttttgcactactaagtttatagcccactttaaagaattaaaatttttgtacatttaatttcttaactcccatcatctcaattttttattttctgtcttgtaatttaaccagtatatcttcatttttaactctttacttagtagtattttttctgcatttaatctcctgtttttctatattaggttttcttgaccagttactttgaattcttggtcttctgaaatgtgattagttttcttctgtttaaattcatatcagtatataaatgtgatgtttgttctgaatgtgctttgagattttaatattaaaatgtacattagaatctcagtgtcacattatttattaatgagtggatttataaggtaagctgtcctagatagacttcattcaggagtattaaaagttcacctacaacatgtatgcaagttgtagctatgtaagtgttcaaagaattgttagtatgagtcttgttatactttagtacatcagagtagagagtgagaaagagcctacaattagaaatttagaatcaggacttttgcctgttttgtgcctctgttcatttatctctaggggagttatatcttgatcatccattatttatggaagagatttataactccatctctgcattactacaatccattcttgggttagaaatgtactgtaatgtttttggcatcagaattatgatatagtttatataggtttaactttgtgtgtgtgtgtgtgtgtgtgtgtgtgttttgagacagagtcttgctctgtcgcccaggctggagtgcagtggcacaatctcgggtcactgcaacctctgcttcccaggttcaagcgattctcctgtctcagcctcccatgtagctgggattataggcatgtgccaccatgactggctaatttttgtatttttagtggaaatagggtttcaccatgttggccaggctggtctcaaactcctgacctcaggtgacccacctgcctcggcctcccaaagtgctgggattataggcatgagccactgtacctggcccatcttaggtttaacttttaagtttgtatttctctgagcttatataccaagtgtcggtggagagtgttgacctggaagtcctgtgattggcaggggacaaccaacttagcattacaaactgattgtggaccaatctgagagtggctaattgatgtgcaagcaattcaaagttgattgcacatgtatatgtctatgtttcagatatatatatatgtgtgtgtgtgtgtgtgtgtatatatggaatattgataatgtttgtgaaggagtcgaatattctgaaggaaagtttttttatagaattaaattttgatgctgccactgtaaaatttctatgttacccactgattgctgtcattttccagatgacttttacttttaacagatgtttatctgattactcttggtgcttttacactatacctgttttgttaaaatgtgaaataaaaacaaaaacaaaaacacagaataaccagttaagtccctagttaaaccaccatttgcatttctcccacagagtatgaatccagtttatttaatataaagtgttttaactgaataagaaaataatataattggtgtatgtataattagctagaatcaataatttatttccccgacttggtgagttaaagttgctctatattaatgagttgtaaatacattatttgaatgtatttggagattgcagaatttagtgtaaactaatgttcaagtcatagtggttgttttaacaatagtctaacaaattttattatgtattaagatgttgaaaacaaggcattctggcttaaagaataaagagataaaaagctttcctttattattaatcttgttcataagagacctgtgttgtaggccgggtgcagtgactcatacctgtaatcccagtactttgggaagctgaggtgggcagatcacttgaggtcaggagttcaagaccagcctggccaacatggtgaaacctggtctctactaaaaatacaaaaattagctaggtgtggtggtgtgttgtctgtaatcccagttactcaggaggctgaggcaggaaaattgcttgaacccaggaggcaggggttgcagtgagctgagatcgcaccactgcactccagcctgggtgatggagcaagactccatctaaaaaaaggagatctgtgttgcttaagcctgcctttatcatgagctttaaattaattaaaatatgttaacttttttcttagttcgtgtcatttttttccacaaacctagattatttaatgctggtgatttaaaataccttacatggttgatatttaagtatatgttatggaaatagttcaattaaaattatctcttgatttttcatgccaataggaggcagaatataatggatatggagaaaacagccacaaaataaattaaattttaggtttcatacacaaattttcacagcagatttacttttgtgtattctttctatggaagaaagatataatattatgaaatgtttgaggattgtgagctaaatgacaactggttaaagtagtatagaaacatacctggagtttggagaaaataaactggggattaaaagttttctgttaatagagagttgactataatggtggtaatagctttgatgaatgagtttgatgtttcacaaggtttatttaatctgttttctttgtgtctccctaattgaagaattatgtttaagtaacagttttaaaatataattaggaaataataaatattgtcttcttcttttatttttttcttcctcttctttttttttttttttagggtatgagtattatagaacaattagaccctgtatcttttagcaattacttgaagaaataccataatactatatgtggaagacatcccattggggtgttattaaatgtgagtatccttaggaagccttgacttttaacatttggtcatatgatattccaaaatattatcattgtgatacaatggcatcattggttttatgtacctatggtcaagtttctttttagtatctttaatataatttggagttccattgcttttggttacttgaataaagttatttatcattggaatacagttcaatactttctgttaaatacaaaaagttatttagaatagagacccacattttctcttgactcttagttccaatatgctctttataaatacaaaccaaagtgacctcttaagagatatggtcttattaattttttggttttatttactggtctagactctataaaaaataagtggaagattctgctcttaaactttaaatgttcataatgtaataaagcaagacagatgatgtgtgtttttctcattaaaacaaaaataatgtttatttcagttaaggaatggtaagagtcagaagtttcggttagctggattttagaaaaagaaatagcatttttttcttctaattaggaaaactattaatttcttgaatgaaaatatgacattaattaagaaagaagaaagtgtatactcaggaatgggaggagaaagtaacaatgggcttatttggagaggcagggaaataatggagaagataatgtagtccagaatagactaagttaggaccttaagtccagtattattttaatgtgatttgaaaggtaatatattgtgggtttttaagaagggtttttcttctaagctgtattgattgactcaaagaaaagcttttcaagaacttaaactaatttttgaaaattgaagctagaataaactgtactaatttcctaaaatctgaattgaatcaaataaaatttgtattataaagtaaatgctgaaccaatcgacaattaaagtaaaaatcctagcatataccttttagatttggattttaatttgtatacatttcaaatttagtcaaagtcagataaagactccgacgtcttaagacagaagtggccagggatttggtttatacggtaaagagaaatatatttaaaaagttaaaaagggtttaaaaaatggccttattacagggagagggagggtaaatgatgactgatacttaattatcaaaaaacaagattagaagttatttgagaaaatgataaggaattcttttttttctattttaatatgatgcaacaagagaaattcaagaaacaaaagagcaaaagagataatctaggcttcagctgtgaagtggacaaagtcaaaccgcaaacacattgagtgcccagttttttatgtgatgtgtgtcctaaccaaatttttcttttttctaggctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 38489 - DNA, 2866 bp, Homo sapiens
ctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgaggtaaagggatcggcgcctcgtgggggctggtggccggacactggggggttgtgttggctggaggagtcagatgggtagggttgcacgtccagctttggtggactgggaaagtcatgtccagcctccggggcagaaggcagaggggacttaaatgacccacatggcagggcttgtctgtgtgtgtctctatcccccagtcctgtgcacagcacctgccaaatacacggtgtttgacgcagagggatatgtgaagccccagtcttgcattgacatgtgagtgagctgggagggtggggaggcttgtggaagccaggggtcgctgccacctgttgtctgaggtctgagaccttgccccctttaacctatttgccctatcctctgcctgtgcccctaagggagagacttctggggggaggcccagatttccttggattactgcctcattcaccccaatgggcttctctcctaccttgggaccagtgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcgtgagttgggagactgggatcttgagttctgtagggagggaggaactagcatttccctagagatgagataaattggatttgaagaagtctcctggttcagtcttttgtcttttggtggaaacattcctccgagttgagattttatatcaggtgagggggaaaagacttacagcttccctggtttctgacttctacttagaggaaaaagttcttccttgactgtaaccgcagtacttcctatcatgtggtagctcagttcagttcaataagaaacctgtattgagcaattaaccctgtaccaagttgtgtgctgggtatgagatcaagagaggtccctgcctgtcggataggtccacagaagagagaaaatgaatgctgagggactggaggagagagttcttgtggtggtggggacagaggctgtaggaaggagaggacacttgcagtgtacccctggagggcagtaaaaagtagatacagggtgtgatggctcacgcctataatcccagtgctttgggaggctgaggtgggctgataacctgaggccaggagttcaataccagcctgaccaacatgatggaaccccgtctctactaaaaacacacaaaaattagctgggagtggtggctcgcacctgtaatcccagctagtcgggaggctaaggcaggagaatcacttgaacctaggaggcagaggctgcagtgagtcaggattgtgtggctgcactccagcctgggtgcaacagagtgagactccgtctcaaaaaaaaaaaaaagtagatacagggtgtggtgactcacacctataatcccagtgctttgggaggctgaagtggtgggaggattgcaattgctcgaggccaggagttcaagatcagcttggacaacatagcaagaccatctacaaacaacttaaaaattagccgggcatggtagcatgaacccatagtcccagctacttaggaagctaaggcaggaggatcacctgaggccaagagttccagaccagcctggacaacgtagtgagactccatctctacaaaaaataaaagataattaaaaaaaaaaagtagatacatcttccttgttcaggcttctccctggaggacctgggctgggcaggagtgggggctgcagcatctgatgagtcttgtttctcagacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggtgaggacagtagtggccagggacccaggccccaggaaaaagggagaagggacgggaggagagctaacagagccccagggctgcccatgcgaccctattctttctttgtcccccctccaggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgat

SEQ ID NO: 38490 - DNA, 5912 bp, Homo sapiens
ggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccaggtagggctgggggccgagggaccggctcgggggcgggggggaagtgtgcctgaccggtctctgtcctcagcgagggatgcggagacgcccctgaacgaccatggcatcggccgacgagctgaccttccatggtgagtgcggccccgacgtggccggatctcccactcccgccccgggccagaacctccccccgatacggcttccaatttctctaccccgaagcctaggcggctgtgaaccctgacccaggagtgagacccatctctgactcgaaccccgcccccgccctgaactcagacctcaaacccgagcctctcgtccccagaccctgaccccatcccagcgtcaaccctaagttgcagttccactttaggaggaagggaacagatgtcctccggatgcctccaaactgaggaagttgggccccaccttgggggagatcaatggctcagcagagcctccgcccccagatgagcatcggtttagcttgggcccagtcgagttctttccacccctcaaacgtgcgtgtgtcccatatacctcctccacagaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcggtgagtccctgtgtcctgcctccttgcagcccccagctgacccaggctctccgggcaggcactgaatgcccgcaatgtgcagctcctgcaggagcagcagcagcagcagcagccgggattctggaccttcagctactatcagagcttctttgacgtggacacctcacaggtcaggctggggaggcaggtgggatggggctcagagttatgctcagggttcagccactcttcccctgggcagggtgctggtgatggtgggtgctggtgaacgaactgtggtgctctcaaagggttatggtgggactggttatggatcgggactatgggaacacaggggacacacacaatctggtgggttagagaaaggcctcctgggggaggtgaggaattggctgagacctaaaggagacagaaggcttccctggggaatagggtagggaagcaggagtatatgttccaggcacagggaacagcatatgcagaagaccaaagatggactgggcgcagtggctcctgcctgtaatcccagcacttaagggggccgaggtgggcagataacctgaggagttcaagaccagcctggctaacatggggaaaccccgtctctaccaaaaatacaaaaactgccgggtgcggggtggctcatgcctgtaatcccagcactttgagaggcctgggtgggtggatcacctgaggtcaggagtttgagaccagcctggccaaacatggtgaaaccccgtctctactaaaaatacaacaaaattagccgggctttgtggtgggcgcctgtaatcccagctactctggaggctgaggcaggagaatcgcttgaatccgccaggcggaggttgcagtgagccaagatcgtgccagtgcactccagcctgggcaaaaagaatgagactctgtctcaaaaataaaataagataaataaaataaaattaaataaaaaataaaataaaatagaaaaattagccaagtgcagtggtcggcgcctgtaatcctagcactttgggatgccgaggcggtggatcacttgaggtcaggagttggagaccagcctggccaacgcggtgaaaccccatctctactaaaaatacaaaaattagccaggcatggtggcacacacctgtagtcccagctactcaggagtctgaggctcgagaatcacttgaacctgggaggcggaggtggtagtgagccaagatcgtgccactgcactccagcctgaacagagtgagactctgtctcaaaaagaaaaagggggtgctgaggccgggtgcggtggctcacgcctgtaatcccagcactttgggaggccaaggtgggaggatcatgaggtcaggagatcgagaccatcctggctaacacggtgaaaccccatctctactaaaaatacaaaaaattagccgggggtggtggtgggcgcctgtagtccctgctctttgggaggctgaggcaggagaatggtgtgaacccaggaggcggagcttgcagtgagccgagatggcaccactgcactccagcctgggtgacagagcgagactccgtctcaaaacaaaaaaaaaaagagggaaaaaaaagagggggctgggaacggtggctcacgcctgtaatcccagtactttgggaggccgaggtgggtggattacctgaggtcaggagttcgagaccagcctggccaacatggtgaaatcccgtctctattaaaaatacaactattagccaggcgtggtggcacacgcctgtaatcccagctactcgggtggctgaggtaggagaattgcttgagctcgggaggcagaggttgcagtgagccgagatcatgccactactccatccagcctggccgacagagcaagactctgtctcaaaaaaaaaaaaaaaaaaaaagagagggaaaggctgagttctttcaggtggggcatggaaagagaagggtggaggtcagcagggaaggagcctctcaggacaagggagaagctcctggcagacttccatccttgaccttggccttgcccccaggtcctggaccggatcaaaggctcactgctgccccggcctggccacaactttgtgcggcaccatctgcggaatcggccggatctgtatggtgagtgaggttgtgcatttggttccttgatggatcactcaacaagtgtggcctgagttgcagatgccagtgtatagctgcggacaaatcagtcactcagacagtgtgacttacctgctgttcagggagacagagacatgaaggactgcagagggtggcgggtagagagcagcagagcagacaggaggagtggccctgcagttctgcagggtgcagcagggcaggcctccctgaggagggtgagggaatgagccttgttggcaacaggaggggtgggggagacctaggaaaagaggcttccagaaacgacgtaagcttcatggcaggaacttgcatgaactgcagggcggcattaccactggagcgagtgagctgcagggaggtcacaggcgaggggacagatcacacaagcctcccatgctgtggcaagaagagatcttttttttttttttttgagacagagtctcactctgtcacccaggctggagtgcagtgatgtgatctcagctcactgcaatcttcccctcccgcattcaagcgattctcctgcttcagcctcctgagtggctgggattacaggcacgtgccaccatgcccggctgatttttatatttttattagggacggagtttcaccgtgttagccaggctggtctcaaactcctgacctcaggtgatccacccgcctcggcctcctaagtgctggaattacaggtgtgagtcactgttatctggccgagaatggatctttaagtgttttcggggtccctctcgccatcatgagtggcgagggcggaagccaggaggctggggtggaggcggccacatggtggggactgtggatgtggagagtggcactggattctggaacgtgctggggaagtagaagagactggctttgtggctagataggtgggggtggggggagtgggaggttaggagcggaggcaggctctagggatttctgcctggactaacgggatggatagagttgccacgtatccacgggaccagcttggcagtgagggcagagggcaagggtgtggatgaagccggagatgcccacccgggagcttgaactggagcctgcagtgctcagggcagagccctgggctctagaggaggcataaggccctgggcttgaaggaggtcatactatgggtgaacgcagacatggaaggggccaagaactgggcctggctgctccccatggctgaaggggtcagagagtcaaagaggaggtgacaggggttgaggaattggcaccaatgaggtgagacacaggccaagggtgtgcagtcctgagtgtttcggggagggggatgaactgacagccagcactgggctcagccaccaggaggcccccggtgtcctggtgagtcaggcaaggtgcttaggaagaggctggggtctcagcacagctcagtcaggatacatgtctgcttgtcctgggagtgcagggcccgggaccctgactgtgccccctacccccaggccccttctggatctgtgccacgttggcctttgtcctggccgtcactggcaacctgacgctggtgctggcccagaggagggacccctccatccactacagcccccagttccacaagggtaagcagacgggcaggcccaatgcctggcagggccctggggtacagggggtgactgctcaccttgccccccccagtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtgagtgtggcctggcgcggagtgggtggtggctgtgtggggacactggcatggtcacctgccgcctcattcccatggtggtgagggtggcctggtgcagagtgggtggtggctggggggactggcatggtcacctgccgccgtgttgctcccaggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaaggtacgggtctggggtggccacaggtggggccgaggggctaggggggcatgggctggccctgcctctgaccccaggggtcttgtgcagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggtaaggactattcccagctgggctaagggggctgccctcccactcccagtcaaggcgagaggttctggggccactcccagacaattctttctttcaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgc

SEQ ID NO: 38491 - DNA, 147735 bp, Homo sapiens; identical to SEQ ID NO: 38053

SEQ ID NO: 38492 - DNA, 510254 bp, Homo sapiens
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaagggtgagtgcacgctgcctgccccgagtgggcgctgcggctccggcggctcggggctcccggggctgggcgcggggctccttcgggcggcccggccggagccccaggataagcgggctgggttggcggggggagtgggatgccaggcacgaggactccccctgccccacgcagaggcatggaggtggggaccctgagcgccagcagccagcaggcttaggcgtctggccgccctgggaacatttacctgtgcccgcctgtgcgctgcttactcgcgagctggaggtactgctggtggcggtggtggggagtcttactctccatcagcccccaaggccagggataaagttgtggtggtagacccggcacctgtgcaggtgaccacctgtatactccttggcttgctgaaggattcaaggggactgcttaacacacagttgtccgtatgttctccatccagagagcaggcgggatggcccgagtagagagctcttcaaccccctttcagaacaggtgccgggaacttcagggagagaaaaagtgttggccctccagctatgggctagtaggggacttgttctcctaaaatgaccactcactgggaagacagggaattcttcctcagaggtcccttttgcagagctgctgctgtggaagaaatggtttgcagtggaccacgcatcacactgtccgctcctctaccggtgctctgcgcaaagtctgccctttaacccacaacttttgtcttgtctttgtccttggcctttcttgagctgaaatagatcttgtgtgctcccaacagttgtctgctgaaacagcttcgatcctgggattcagctgtctataaaatgaaggaaaaacatgggagaataactgttgtaaaatggttttatatcccggccgtggaagtggcacgattagtgggaaaacagccatgtaaagggttgtgagaaagaaacaaaacaaaacaaaacaaacaaacaaaaaaacagttacaagtatgtgctgtggtgttgaggtcgacgtagctctaatgcaagatgtcatgaggtgcagaataaagacattttgatagtcaccgtaaaatattttcaaaggtgccatgaatttaaaaagggatctcccccagcttggctggtctcctgcttggtggggaagtgaaacaggcgtcagtcttcattcagtcttagcagaccgcttgacagacttcatcatttatggtaatagcagagagtccgtcttggtcttcagtgaagctgttcaagactccacggctctctccattgctctcctggatctcagatcccgtagccttgggttctgacatcaggaagggggccgtgccggtgtgagggaagcagaatctctcccagggcagattcacatctgccagacttctgtctactgacagtctcactaagggggttttcccgaatcccatttttattttccttttttatttttctccagtgaaaaaccagtttatagttcatgccacctttggaaagggctattcctagtggattacacgctggccatttttttctggtatgttggggctctatgagacatagagttcccaccactttcaagaatataaaagacatttttttctgggtgaaggatgtgactcatatagttaagtcaatcagtgacagggggctgcctgggccctgaaaagctgggatttgggaggagaggaggccagacactctgcaaacttgaaacctggggactggaatgtcattttggaatggtttccctggtagtgacatttctattcaggtgccactgactcagatttagttccatagcacggccttttccgcatccctccctctgtcctacctttctccttcctacctttcatattcttttttcctctcacttcctcttcctcccttctcatctctgttggtcttaggacccctccacaccccagtaactgaagatctaacaggcaaaagccaaatgttaaggaggatgccagccagcctccctgtgttgcccccgaatgacatatgagttgaaatggtctccaatcacttttttttccgttaggtattgatgattttggtatgtgatgcacagtagtattttgcagcaagacacaggtttttctagataatttttaacatattaattaatgtgtgtgaatctgcaaatgataattttgcaaggggaattgtcgtttggcacacgtaagcatttgaatggtgacttttaccctggaaacttggagcacacactacctagtggtcctttggtacagatactgaagtttggaatggagcattgtttcgaagaccttgtggtgtagagaggctgagtgattagcttaaagtcacacagcattcgaagagtagaggaaaaaaccaacctgaggtaacctggttttttgttccctactctgtcctcatattcaaaccaccatttgggtgtagctttgtaatatttatataatctcatagggggtaccttcataatgatcaaaggtaatattttcatttagtcaccttgaaagccatgcagtgattgttaaatgtaacttctcagaagctcgttttctaacacatattgacctttccctccctccttccttctgttggcccttcctccctctctccttccttcattctttcttccttcctgctcccttcctttctctcttctttcctcttaaaatgacagttcttttaccaaagcaaaatagagatgtgtgataattatattatatgatgtttcataacatttctaatcatatggaatccaagatccctttctagacatctaacgaaactcagatttggctatgtactgaaaagttttggttatatactgaaaacattttccacatattcagtatttggttatatgcagtaagaatctacattgattcttttctgctgaggtgtaacatgaggtctgcttaatttaggtcaggaagaattagtgctggaatcaagaaattctaacaacaaaagcaataataataactggaattttggtgggctcttatgtgccaggcaatgcgctattcccaccttataggtattgctttatttaatctgcagacactcttttcggaggcatgagccttcagtggtggaaagcaatgagctctagttgccctatttagttgttatggatgaagatctcatttttgatctctgttttcaaagccaattaaaataaggtgttagatttgctgaggaggattttctttcctttttgcaatgagaatagattacttttgtgtattttgagtggtttaaaagtgttatatttttctttgacatgaactacccagccattttttttccagaagtagtgtggataaagcccagggattctaactgaggagtaattctagactttctctctagaaggttctcagggaggtcaatagtaattaagaaaaaatatacaccagcctaggcaacatagtaagaccccatctcttaaaaaattttttttaattagctgggtgtggtggtgcattcctgtaatcccagctactcagagtctcaggcagcaggattgtttgagcccagaagactgaggttgcagtgagccatcattgtaccactgtaccccagcctgggcaacagagtgagaccctgtctcaaaaacagaaaaaaaggaaaaaaagaaaaaaattacacacacatgcatgtacatatacacacacatatgtacatatacctatgtgcatgaatgtatgtatgtatttatgtatatactttgagctactttctatactagttgctattgctgcataacaagtcaccccaaaagttagtggtgtaaaacagccacttaattttttttgcttatggatactttgggtcaggaatttggatgggggtaatggggctggcttgtctctgctccactacatctggtacctcagctggaaagattgcaaagctgggtggcttgacagctgcatctggagtcatctgaagcaacacctctcccatgcctggggtcgatgtggctcttcactggaccctcagagctgggctgccaaccagaacacccacacgtggcctctccatgcgatctctttatgtggctcactttgaactccctgagagcatgacatctgggtcgcaagggcggatatcccaaaaggacaaggtgaaagatggcatgtttatatcctagcctcataagtcacagtcacagaatgtcattttcgctattttctgttagtcaaagcagcgttagatgtcagcccacgttgaaggagaagggcatagataccagcagtcattcagtggaggagtgtagggtcacattataagagcctctgctgtgggagatactgctgtgtctgcctttttaaaaacccaaggatctgaagggatcataacttggtagtgaatgtagacatttcccaaggtggctaaggtgaatgccacatatgcatacatacaaacatatatagacaaacatacacacagacgtatgtatgtatgcatatattatctttgaaatatcttccattcatgaaaatattgctgcttattttagctggtgtggggtctagaagtggtatttgaaaaggaggttgcagtgggtatttgaactgcaaatttaaattgcagagctgagagcccgtctttgcctttgtggctgccgattcctcctatggcaaatgaccacagctgttgaatccttcttatggctcagtgtgaggactgctggaatctccagctttgtttccctcttctatttccatgcatccccactctggtttttcctctgctcctcaaaaggtctatgattcttccgatctcagattcctggcgcttgctggtcccactgtctggactgctttgtccaccatggctagtgaattcctcactacctggctcgagatcttcctgaatagactgggtccctccatttctctgaatacaccatatgttcccttcatagcatttatcacagttggtaattatgtgtttatttggtcatgatttgggtgatatctcctcttccccagattctagggtccaggaggtcagggaccctatgaactttccgtacctctgtaccccagtcactggccccatagtaggagctcagaagatatataaatatcttaaatatagaggcaaatataaaaggtatttggtaaataaagacgctcttttgatcgctgaactacagtgcctgtgataaaagtagtcatcctgtgttaggagcccatcagctgacatggattttattgtcatgatttattaggttggcgcaaaactaactgcaggttttgccattgataatagaattctgctctcagtccagcagattcgatatcattacccatttctcatgggatagcactgagctgaagaaaggtggagtgcagtgcctagtgtctgttaagtggagggatttgaacccaagtccacctacatcagggctgcatgctgctgcgttttccagcctctgtggaggaggacatgaatagaagacggggaatcaccctgcctttttcagttaactgaggagtaaggagtaacagaaggttggtttcatagaagcagtattttagaaacacattgcttttcaaccttttctattttttgcataaacatatatagatatgtctctttcctcttggcttttcttagcttctcatcaacccagatttttctcaaagatttcctccacttgcaagcctcaaatccttgtgggaagctttttttttttttcttcaccctggagggttggtgaagctaaaagaattgcaaaactagatatttgctgaaaattccaaggcctggtggaagatggctgataggacaaaattttggcaattttctttttctgtatggaggtttcttttccttgagtgaaagaactttttggaggaataatagtacacagactttcataatggggaaactgaggtatggggtggttagaaaatgttcccaaagttgcaaagcaaatgggttatgctgccaggaaggtaatttggattttttttttctggtccatttttgccttctttttctatagagcttgtttggcaattatttatatttattgtttgcaatggtttcacaaatgggattatcctgtagcatttgagaatgtgaagtattaaggacccaaatggaagaaggttttgtatgaaccaagtggtgatgggcttcaggtttcctaggattccccctgctgttctcttcctgttccacttccaacctggagaggcaatgctccttgctgttgctagtcccggacggcccacactatcccttattggtttcccagccctactcttacccttgtaggctgttccttcatgaagctctctcagtgggatcccttgagggagttcctgcccggaccccagttgcgtaagacacggggaccttcacccatttgttcattcaacaaatggcaggctctttgctagttgctagggtggcagcgttgtcttcgagggacaccgtgatgttcatcctcgtggtgctcaagcttgagtgagaagagaggtgctgaacaagtaattttcatgaattatgagagatcgggatgagaaatacagcatggcatggaggaggctgtggtggtcaggaaaagctggaacctgaataataaagggaataagattgaggaagaatggaggatacaaaggcaaatgtagaaaaataggcaaaagatgcagacaggcaatttacaagaaaacaattgcagatggccaacagacacaaataacaaacttaatctcagttttaacatgaaaatcaaattaaaaataatgaaataccatttctcaatatcaggttggtagattaaagtaaattaaaacatgggctcacatcaagggtttgtacagattctggagacacagctgttctggttcacttcagaggaggttgtcagatggcactccagacactgcgggggaccatcatcaggggacctggttataggaatagaccccaaatgaagccttggccatttaatgcaattgacatgtagaaagggaggtgggtggattagaatggctatatgtagatatttgagacttgggtagaaactcatcttagctggacccatccatggaccatggagcatgttggtcatgaccttttcatgtttagttgcttaggtgggagctccaggaaacaaggaaagacctgtgtcattcctggaactgtctgaaccaataaacatcacttatttaaatcatgaaatctagtaatcgtttttggcttgtcaatagtgatttatttttaggagagagtgaacaaataaagtcagctcatctgtgacctaatttagggactttcacatttgcaacttttacatttggaatatttgcaacaaatatttctcttcctttctcctttgcatttctgcattgtttgatctcagcaaaagtcattttcactttagtcagccagtctgccatggaattgaacccacagaggacagagaaaggagcaggtttcttgattaggaccttgacaatagaacaaaaggggtgggataagggattggtgacctcaggaagtcgataatgccatgtttaagacagaacatgaaacatttatttttgaagatttggacttttagagcatctaggtggaatatagagctgacatttgaaagtcaaggtgataagcatttgtggctgcagataaagatgttggaatggtatgcatgagggtaaacattacatctatggttagctccgtgcttctcagtcttgtctgcacattgtaatcactttgggaactttaataattactcatatgtgagtcccacctcccagaaattctattgtcatgctcccagttgtggcctgggcattgggattttataaaaaagtaatacagttggtgccagtgtatctcagcagccagagctaagaaccaaagggttaaaggttattctttaccttatcacaagcacattttgctgttcgtcattgaggtacgaaatacactgtacttaaatttcctgtcctggatgtgaatatatgtgtttttctgcttcattttctaagccttcaccactaatttaaacttaaacttctctccagttgcctagatttccttttctttttagagacaggatcttgctgttgcctaggctggagtgtagtagcatgaacatagctcactgcagcctcaaactcctaggctcaagcaatcctcctgcctcagcctcctgagttgctgggattacaggtgcgagccctcacacctggctcttccatctcctctcaatatgtgcagggacactaagtattccagcacgtcttctttggaggaagtctttaccagattcctctggcctgctctgatctagacaggtcacttgtaaagtctgctgccagctgtcatcttcccattgcccttcagcttcatcctgcatatttcttttaactttcccttgggatgaaagccctgctccctggaacccaggtatgcgtctttcttagcttattcctgaaatttcagtgtacatttttgagggtcacagcctccaggtgcctcctacaatagggagtgtggaaagtaaagattcaagactgtatgtgctttaaaatatattccttctacctctacacttagaagatagttagactgggtcaagaatttaggttgaaactcatttgccttggaattctgaaggcattgcttgaatgtcttctagcttccattgttgcctctgagaaatctgctgctgtcttggttaatcattttcgaagcctgtatccaccccccgcctcaccccaagagcatgtctattctttgctttgctcctaatggtctattttttcctaatcttcaatcacgtcacaattatatgactggcgtgggtctgttttcattcattttcttggatctttcaccaggttctcttaaactggaagcttgtcttctttaggtctggaaacttcccttttataatattctccatcctaagtactcccttttctctttctggattgtctattatttgggtgtttgacttcctggattgaccttctaattttcttatctcttctctccaatttctctcatccttttgctctaatttctatagattttttttaaccatgtcttccaactcttatactgagtgtttaatttctgctgtcatatttttaatttccaagagctcttcttcctgtggaagctatttttagtagcatcctgttccgcttcagtggtacaatatcatctcccatatccctaagtagattcgtagtagtattgaggttttcttttccccatatggactcttttttcaagttgctgttgttcctttgttttgtcttgtttttcatattatacatgctttcttcagatgtcaggggatctttggcaactacttatatttaggtggtgctgtggaaaagatgactggaaattgtgcaaaggagggtcttgttgattgtatctctgttatgctatctaactgggctattttattgggcaatgcttcatatctcaagttttagatctctgtcagggggtggtcagttttcccagagaaagatcactcagcatcctgtcttgagggaaaagacctagttacttctgagaatccgataggagaggaatctgggaatggggaaggttttttcaacagaaacactcccctagactcaagatatattcagccctcacaactgtgagtaaggaagcactaaataatttatttagatatatagcaggaccatcccaaattatttaatccttccttccttccttccttccctccctccctccttcttccttccctcctccccttcccctccctcccttccttccttccttccttccttccttccttcgttccttccttccttccttctttccttcccttttaactactgtacacatgaatctggtaagagctactgcctcctggtagaactaatggtcagaagtaaagagaaggcttaatcttccccatacccctttttttaattgaaaaattttttagagaatttcagattcacacacagtcataagaagtaatacagagggccaggcacagtggctcatgcctgtaatcccagcactttgggaggccgaggtgggcggatcatctgaggtcaggagttcgagatcagcctgtccaacctggtgaaaccctgtctctactaaaaatacaaaattaactgggtgaagtggcgcatgcctgtaatcccagctactcaggaggctgaagcaggagaatcatttgaacccaggatgtggaggttgcagtgagctgagattgcaccattgcactccagcctgggcaacaagagccaagctctgtctcggggtggtgcggtgggggagaagtaatacagagacatctcttacacattttcccatttcctttacattttgcaaaactatagtataatatcataaccagggtaataacattgatacaatccacgaactttattcagatttttccagtgttatttgtatggtagtccctcagtatccatggaggatatgtttcaagacctcccagtgaatgcccgaaaccatggatagtactgaatgctacatacactgtgttttttcctatacctatataaccatgataaagtttaatttagaaattaggcacagtaagagattaacaataactaacaataaaatagaacaatcgtaatatactctaagaaaggttatgagaatgtggtcgctccttctctctcaaaatatcttcttgtactgtgctcacccttctggtgatgatgtgagatgatacagggcctacgtaaggagatgaagtcaggtgcatgacgtaggcctgtgacatagcgttaggctactgttcaccttgaacccaggcactgccacaccatgacagtcgatctgataaccgagctggctactgagtgactaagtgactgcagaatggatcagctggacaaagggatgatttatgtcccaggcgggacagagcatgacaacttgagattttatcacattactcagaatagtggcaatttagaacttaggtattgcttacttctgggtttttccatttaatatttttggactatggtcgactgcaggtaactgaaacagcagaaagtgaaactgaggataaatgaggactactgtacccatgtggtgtgagtgtgtgagtgtgtgtgtgtgtgtgtgtgtgtgtgagagtattgagttacacacagttttatcacctgtgtaggtttgtgtattcattatcacattcaagatactgtacagatccaacaccacaaggatcccttatgctgcacacccatgtgtcttttagtacaaaaggagtagtccagtaatttatgtcacctattcccaaaaaagtcaattaaaaagtataacgtcaagaattaaggaaattctacccccaataattttgcactctacacaaaggatttcttgcaatttggggcaggtcagtctacattagtaaaattgaaccatgaagggttttctccatggatgcacttttattactgtcaggtatggtaacctgaactacgtgctggataaaggccatgcatggcttgttaacaatttctttgataatgattttttttctgtcatttgcacaatatttctgaatgaatgctccatgaaaatagcttatttgagtagtttgttcattcaagcagcttagccatggcccttgcaatattactttcaccattatctgtttcctagagtatcagagatggagaaactcttggggaccattgaatcttaacatcctgttttacttttgaggaaactaatgtcaaaggaaattggaattggggctggaacccaggctttctgattctttgcttagtaaattctttaaaaaatgccagaaagttaaggttataaaaatatttaatgcaaattaactcttggtaaaattttttcaaattctgaaattcttctgaaatgctggaatctttctgggaattttttggcatttagtgtagttagtacatgggaaaaattaggaattttcagggtgagccacttcttgtgacaaaaaagagatttgtttaatcagaaacactggctgttggaatgctcctaggttgctttagaagagagtttgcattgttggttcaccaccttctacctgggttgtaacctcatataaccattaggatgattgaccgttttgaaaatgagtggccattaattcattttgttaggggtctttgagcttacgagttttcaacttttttcatccttcttgttggaattctgggttgtgatttgaagatacttccaaagaaataaaatattcctaggaccttaagaacccaggctttgtaaacgtgatatgaaggacctcttgaatggcattccacagtttggttgtttgaaatcacaggtgtttgttgggccatgtgcaggaagaaagtcattgtacctactttaagtaaatctgggcatgagaacaggtcaattccggtattttccaagcattgtggaatatttcttcccttacatatgttaaattgatatcatactacatataatgttttagatcctgcttttaaaataaaaaacccctaaacttgacagggtgcagaacaatatatcaccccaaaaacccccctcaagctacccctttatattcatacccttcttccatctctgaaccctgatgtgttttctgttactatagttttgtctttttgagaacgtcatagatggagttctatagtttataatcttttgaaacaggcttttttcactcagtacaatgcttctcagcttcatctaagttgttttgcacatcagtagttcattcctttttatggctgagtagtattccactatacagatgtacaatagtttgtctgtccatttaatgttgaagaacatttgagttgtttttagttttgttaatttatgaacagagttgctaaaaacactcagatccagggtttgtaattcctttttcttgacttattacagtggctaagacttttagtacaatattgagtttgaatggacatccttgtcttgtgtccctgatattagggggaaaacgtttagtccttccctgttaagtatgctatttgctgtaggtttttcatagattgcctttatcaaattgagtaatttcctttttcgccttagttttctgagagtttttatcaagggtggatattggtttatcagatgtttttcatgtatcaattgatatgctgaggtggttttaattctttagacagttaatatggtggattgcatggattgattttcaaatacggaatcagccttgcataccctgtataagacccacttgatcatggtgtgtttttcattttgtatttcctggatttgattgatcatattcggttgagggcttttgtgtctaggatcacacaagatacggacctgtaattttcttcatttggtactatcactgtctggttttgctaccagggtaatactggcaccataaaatgatttaggagatgcttcctcacagtttctggaagaaactatgtacaattggtgggtcatgctttttaacttatcatgggcatccctccatggaattaatcttaaaaactagttttaatgtctgcttaatagtaataataatcacagtatttttcttcatgttacagcatgtaatgtttattgggcatttagtgtggccgaggactgttctaagtgctttacttgtactgactcctttaatctccacaataactctatagagtagataccattattatctccaatttacatgcgaagaaaaataagacaaacagtttaaataacttgctcaaggtcacaaagtttctatgtggtcaagtagaatttgaatccaggcagtctgattccacatcctgtggtcttaactattacatcgtatcctttgattatgtcataacttatttattcagggttccatttgagatccatattttgagattttccatgccttcactttgatgactgttcttgtcagaagtctttgacaatctctgccggtttctttaggttggatttctaaaggtggtatttcagcatcaaaaggcatgcccatcgtaaaggctcacacgtactatcatgtaactttccaggaattggaacaaatttgaaatcccaacagcagtgtttgagagagctcaattcgatgttctgttgcctgaattatttttatatatttttaattcaatttgattgtagaaagatggtgtcccgttggtttagtttgccttccttctttaccgagcaggttcaacgttttacacgtttgttgaacttttatatttattttcttgtgagaagggtttgctcatatccagtcttcattttcttctaatgagttaatagtgttttttcttaatgttttgtaagagcttttatatattttgttttactttgccgtatttcaaaagtcttgttcattcttttttttttttggcatagaggattctcatgacatctggcccacgccgtatctctttccctttattttttcatccgcctattcttagattcaggctcttagtcaacgtatttattcaccatttgtatggtttactttttaaaaaatttaactctttacttcatttggaatttattttagcataagattaaaatttaatttaaacagattaacatatttaatagttaattccagaattgtttattgactactgtttcctctacctccacatttgtggtatcacctttattccatgcctattctcttatgtaccagaggcaaatattttatgatatttattttgttatatttactcattaattaattgtaacttattagcatgttaattatctggtaggtcaagacacctttcctgttttttgaaaaaactatttatttattgttatcactcatttatctttccagatgaatttataatcctttacattttctccaaatccttctaggttttgataaatctataaataatttatggaaaaatggcattttataatgttgattctttttgttcatagtgtgtttcttcatttgataaaggcttttaaaaaatttgtcaagattcatgattatttctctatttcttccttacatttactggtgaaggttactctggtatttattatttgttgttgctcttgtttcatcccttaatagtcttttaaaatattgcttctttatattttattcttaaaaatgtgaaattatacaatactgaaaataaacttattctatgaatcaatatctttaggttcattctgtagctgaggagtttttttactgttggaagactatgtgctgtccattggggtatggatccccttggctattagtgacactggttacttttcattatgctgtggaagtttcctttcatttgtggttttctatattagaaaaaaatcagggccgggcgcggtggctcacgcctgtaatcccagcactttcggaggctgaggtgggcggatcacgaggtcaggagatcaagaccatcctggctaacactgtgaaaccttgtctctactaaaaatacaaaaaattagccgggcgtgggcgtggtggtgggcgcctgtagtctcagctactcgggagactgaggcaggaaaatggcgtgaacccaggaggcggagcttgcagtgagctgagatcacgccactgcactccagcctgggtgacagagctagactccgtctcaaaaaaaaaaaaattagccatggatgttgaatgtgatcaaatgccttattaacacttattaaagtgtttaatataacaatatatatagaaaaaaatatccttactaaagcacttctgaaagtgaatcttacaaaggcatgacatatatttttaatatgatgctggattttatttatttgcattttctatgaaatttttgcctatatatttatgaaagaaatagacatatagctcctttgccaggttttggtgtcaggatcacactaactttacaaatgaattgataatttctatgttcctctatgttctggaatattttatgaagcatggaaattatttgtatattgaaaatttgacaaaagcacttatagtgctgcctgccttacagtcttctatgaagataattttgaacaaactttaatttctttcattgatacttttctgtgtgggtaatttatgttttcctagagaagtgttaatttcattaatattttagaaatgaacaaaattatgaagtactttttttgttttaatttgttctgtaattgagatcatataaacttttctcagtactaacgtatatgtttatttttttcattgataaaatctgactgtatttggtgtattttatcaatttgtgaaaatttgtatcttgtatttcttcattaatttttctcttttcccttttccctgagtcagtaaagctttaatatttattcaaaatctcctcttaattcctgtgtttattttcaaatatcttgaatgaaatgctttatttcctttttattatttcttgctttataatgcatttgatgtttagtgtagctttagactcaaactataagttttgaaatgtcatgcagtcattattggtacttttcaaatagtcttgtaattatagtttttattttttctgcaattaattatttgagagactgaattttaacttctaagttgttggagtgtgtgtgtgtatatatatatatgtatatataccaagttctaattttatttcgttttgcctggagaatatgacctttaattgtggcttcttgttggttttggttgtttcccttggaacatgaactgtttgtaatttggatagttatttggctgtgtcttcatctttttgtcttttcctcttcattctgtaagagcctatgtttttttccccttggtaatttgattttcagcactattgggtctgctgtctgctgcctcttattcccatttatgttttgtgtttgcatttctggttttttaaccattttatgtcttgtcatctccatcttagctgactccccttgtaatcttagccttttccatttagtgatttttctttcatatatcctatgtttatttgatattgagattaaaaaaaatggattccaaaatttacatcttcttcccataatagattttttttttttttagaagaatagtgttttacttcagatgttgcagagaattttcaaaattgtcttgagttatcaaccttgaaagagaaggtccaggccgggggtgtgcctgtgaacagaccctcctgtcccttcagcgccctcaccactctcacctggtcacaattgtcaggttactgtgagcatcgcttatgctgaaggggtggttgttgtgcatggtccctggccaaccttccagtgttgatgttgacttttctagggtgactcagcttgcctgagaggggatctcctgctccttctaccttgtagttagaatactgaggtggaaccttattcattataattttgatcagtgatagttcttcctagttcttatatctagagacagtgtgtgaaaatctgccaccctggtttgatccctcctgtggctctttccatcgcacctcttttctattaatctccagaaggctccataccaccctccttttgcttctttgcctagttgagttgcatttccgggaactggggtctctgaatggatgggtatagaaagacatattgatgggggggaatggatgggtatagaaagacatattgatggggggggtgccctttacaacagttcctttcagcaacaaatgcctcatgtttctgagatgggattcacacctggggacccatgtgcccttccacagtccgcatgtcacaatcccttcttgtgtgttaggcattcatccacactcagcttcttttatgcatctctgtatttccttcagtgggaatgacccattgaagggtcattgggtcctaatgctaggctaatgaccatgcatcccagaatgcctgttcagattttagcttgaaatttttagtttgttacaaagaaaaagaaattgggatttgggaacaactaaagctatccgatattaactactctgtcttagtattttttaggcttacacctgtttctatggtttaccccacgtaattatctctgcagaaccatggattaggtattattatcctcatttaaattaaagtaactttcccaaggtaaaaaacaggtagacagggcagttttgaacttatactttctgtgaaaacactcttacactattttccccatgccaaacatctctgaagaaagacatttctggatatttctgccaggaagttagacaaggagctaccccagtgtggtttgcagaatagtgctcccgaagatgtttacgtccgaatccttgaaatctgtgggtttgttatgttacgtggcaaggaggagttcaagttgctgatggaattcaggttgcaagttagctgaccttggaatagtgagatgatcctggattatcagggtgggctccgtgcaatcacatggttcttgtaaaacagggaggcaggagagtcagccagagaaggtgatgtgccaacagaagccgaggtcagaatgatgtcattactggcttgaagatggaagaggccgtgagccaaggaatggggggtgcctccaggagctggacaaggcaaggctgcagattcttcccaagagcttccagtaggaatgcagtcctgctgacacattaaatttagcccagcaagacttctgtaggattctgacttccagaactgtatggggctgttgaaagccagtaagtttgtggtaatttattacagcagcaataggaaacgcacgcacccagtgtatcgaatattggccatggtctaactctctgcagagcaggaacaggaagtcctggagtgattggctgtgtgtgcacacccaccacatggaaatttacattaacatgtaacatgttatcacttgattatatatttattagctcattttattgttgtcaccctcccctagctagaatgtcagctccctaagagcagaaacttggtttggtgcattcatggctgtatgcccagtgcctcatgtggaggagaggctaaagtatttattggatgattaatttttttcccaggtgacattgtaccaactaaatggaagctaacttttatcttgtggtggaatactgtagattatataagtaataatagaaatagaagaaattgagttaaaattatctacccttgacaatcaaaatatttattttcagtgttcagtgtttggtcatatgtgtaaatattattcatgtaggtagtaaatatttccatttaaggatcaaacatgcaacatgtgacattctatttattttgtgatgatcagctctctttattttatgaatatttttatgaataaaataagagagatggttatcacaaaataaatgcaatgttgtatgttgtatttttgacttttaaatagaatgtttcatgttgcacttttgtgacaacatatttgaaataaaggtcactgaattttttaataattatctcagtctggttggcattctgttgactgtataggtcatacttatttattgttggttatttaaaatattatagtttatttgagatatttgaatactgttaactgaacacctttgtgcatgagtctgctgtcaatcatgttagctctccaggcatcaccgtagtagtccagtagcctgcactagctgggaaagccactgacgaggactctggagttagagagcttttgcatattgatagagaactctgttggctaagctatctgcctttaggcttgttgcatgcttttataatttttgtctaaatctatttagagggaattctcacctggcatcaggtgtcctcaccttgcctcttcaacgtcagcttgtgcttcttctatggaaactcattcctcatcagaaatgcccagaacctctatgacaagtgtaggcaaaagcgtagtatgaacgggacaatgatggcaaaggaggagctaccaatttggaaaatgaatcgacttggaaactgaatcaacccccaagagcgttattagtatcagactaaattatctcctttaactgcgtcacatcatgacctttactttttaaacagatatcttgtttttcttatcttctcttcttgacagttgcttcggtttttctacatactgactgttcctctgataacaaagcaagaaggaaaaacaaaattttaactgtcaactgagtttcgcaagagcgatgagcagtccggggtggggagggtctctccccaggctccccgtggttgtacaagccagcagcgttaacggaagtgcacacagcagttccaagcctgggaggagaaggatgtccgctccaggcagtttaggatagttgttttgcctaagatggcaagaacatcacccttgcatcttgagccaaggaaaccatacatggacgcatcttgtcctacatgggaagggatacccctgcaggcttctggggtaccataagtgtcccgtgatggctctttcaccttggggtttgttttccaaacttttctaagtcattggaaagtagagtaggaaggaggggaggaggaaggggagacaagaaatatacttgcctgtgcatgcacttttctgattaatgttctgagtgtcagcacacagtgaaggtttattttagaagacaccaggaatgaaatattttatgttgatattgtgcaggactgatctttattttctgctatgaaggacggtataacttcatgatgctcctgcatctttgtagttcctgtcatgaaatcattcaggggtaggagacatggctcacaagagtgaagggcattgcctagaacaggagtgctggacagtgactctagagacaggagttctaatctcacttcagctattaactttctgcatgttctcttctgttctcagtttctttatctatagaatgggagcatttatgctaaattgtctttatattggtaacactaatttctctctaatttgattattgcttttaagtctctagcctcctgaaagatgctaccttctaaggctaatttatagccagagtaatatggttttgctctgagcatgccctgaatcattattcgttcttatttcatgagaattacttttgtaaatgttattttcttttggtttcacagagccattgagattgcacagctcggatttcttctgcatgtcataaattttgctaatagtataaacccgtgtttttcaaagtgagagccttggaacagcagcatcagcatcgcccaggtcccctgtgagcttgttagaaatgcagagtcatgggcccctccccaacctgctgaatgggagcctctgaggatgagacccaggaaagtttgcttaacgaagttggcatgtattgcctgtgaaagagaagtttgagaagcactgctgtgaaacagggcagccaggaggtgctgtgattttgccctctgcacgtggtcacacactcaagcatatggtttgctccttgcatgactgcacttcagatgaaatgccaagattgagacccttctatgctagtgaagcacaggctactttattgagagcctagcaatattgagagagaaaaatgcagaccttcttggggtagaaaggaggatgggtttcctttccttatgagatgggatccagcttccttactactatagagtctcccatggatggtggctttgctgacttcagagagagctgcaggtgcacaggagcaccgtgatgtcattggtgtgctctgaagaaatgaggccatgagaagaaggtgaacagaaggtatttctaaagggtctgggaagaggaacagcacctatgataatggctatcatttctgttgcacagtactgattattttgatggttggccctgggctttgatttccagccctgtggtcacacacactccttataatcatctgctcccaggagaaggtgtcatgaattctctcttttcctccagccttagctgtcactggcctggaatacggtgtgactgtgtagaagctgttggcattgtttctgcattgtaaactcacacacactgagttaaatgctgctgagcagttaatgtgcccactccggctattttctacccaaggatacttgactcatttcttatatcctctactgtcctttaaagctcaatagtgctctatcggggccatttaatttggtggcacaaggcatgccctgcatgggatgtctgcttttgtttgagtgggactgagaccctggcctggagctgtagctgcttggagcaagaactgcctttttcaaatgtgcatgaaggtgctacccactcatcttccctgcctatgcccctacctagtgcagaagtaaggtgaggtagggtggtgctgtcgccagtttgtacaaaggaccagctgcggctctgggtccctgtatggtgcaaggagaaacatttattttcactcaggtgctctgccttaatctaaagcaaaactcatggacttacctcctacactagggtcccttcctatttacacacctaggttgagtacctgagtctcctgaattcctgtgtcttcatcagagcagcgtctgggaagctgggtctctgtactagctccttcacagcgtctctcccatggctcctcatctggactgtcacctcatctcccctcaagtccagatcttgacaccttgtacttgcaccttctggcttcttacctgtctggccctctagaccccaaccccttcctcctgactgttccagcgcatcacatggactgagcttcctgcagtagctttgagatgctggcaggtgcatcccctgcagaacatccattcatatgtcccagtttctccattacctacaaggtgcaactgagccctgcagcctgcacctggagcctccagatttctgctccagcctaccttgaagatgaagagccagtctgtagtcttcaaggtcaaggtgtctatgggtcataaatgcatttaacagcatgaacgctgggtgacaaacccaataaagaaatagtttcactctttgaacacttgtgaagtgctcatgtatgagacaaatttcaaggcctaatttgactccaacgtcctgaccacttcttctatctcatggcgaacttttctgtttttgaatttattcataatttaatttgatataattcaaccaacttttattggggagccatgctctgttggtaacatatgggtctaaatagcatatgggacacagtcgttgctttgaaggcacctagagtcaagtagggagaatgggcatgtacagtcaaaagactctcatgccacctgtgaggtgcccctaaagagcagtgtgggagtgtgcaaggggtgttgatagtgagtgatatgggttaattccacaagacagctcagggggaagccagcagtgccttcctagagaagcttggagtttctgtccctcccagggggttgatagaccggcccatatatcatagtatgcttctatcctccactctacactagttttagagaaaaaataagcaggcttgtcatggtggctcatgcctataatcctagtacttcggaaggctggggtgggaggattgcttgaggccaagagcttgagaccagccttggcaacatagcaagaccgcaactctgcaaaaaaaatatgcaaaaattggccaggcatggtggtgcatgcctgtattcccagccactggggaggctgaggaggcagcatcatttgagcccaggcgtttgaggctgcagtaaactatgattgcgccacttcactccagcctgggtgacaaagtgagaccctgtctcaaaaacaaaacaaaacaaacaaaaaacaaacaaacttaacatgagcaccaagggcatattgaaaggtcaacagctgtggcagaaacccacagagagagagggatgcaagtgtggagatggagtgagggagtgtcccttggggatggtggctcatgtttataaacctcactctatttttcggtagagtttccctcttcttttctgggctgttattctccaaggaactacctaagctctggacacttccaagccttgcaacgaactttaaaatgtgatattcattacattatttagcacttggcctgaaatgatgacaatgagaaattatggcaacacaacaaacatttgattagctctgtttcattaggattcttcacattttgagtttagagaccctctaggtttcgggagctgcagatgttcatccattttcctttccttctgaagttccttctgccatggaaagagaagttgggaggaatttcagcacctggtgctcctgggcctgcaggcgggggtcagtgtctggtgtggatggcggggtcgtgcatctggatttggttagctggctggccatctgctgttcccctgcctcagctgcccatcttcacctgctttgccatctgtaagtcatcctgagaagggatttcatgagaattaccttctgagaaggcctggtgtgccgtccctttcaagtcatgggaatctgtgctttgtgggttcggcacctgttcccgtcatgtgctagctcagcttgcagaacatccacccagcttgcagaacagcttgggtccagtctctctgagacaaccaaacaccagcagggccaggctggaatctgggctctgagctgatccttcccctgctctccatgcataggacctgtctcttctcctgcgtcgtcattgaatggacaacagcatgagcattgacctgtggctgaattcagctggattgagattcactcttggtgagagggagattgagcaggagagatatgcagctctcatgaggggctcttggtttggcctccttctcatcaaatcccagcctgctccccctttttcctcgcagcctccacctcgccttctgatttaagcctgggcctgagtttcacgtctgtcggttttactttcagtcgattttacgggtgcctgagcggctgtaacattttcctgctgccttttctattttcaacccaaataggaagtgacaaagatggttttggtgcagagagaatgtgattcattttgttacttttttaaaactttttttaaagttcaatatatgtacagaaaagggtatctatcataagtgtatatagcttgatgaattttcactaactagacagcagccgccaaattaagaaacagagcaggatctgcacccttgaaacctgcacatggtccttccgagtcaccccccacaagagtgaccactgtcccagcttctaacagcagagagcagctctgcctgttcttgtgccgtttgtcatctgtgtgtctgttttcttgctgaatgttatgcttgtgagattcatccgtgtcgtcatgtctagttgtaggttattcattattgttgccgttcacagttttattgtgagaactgatggacatttgtgtgatttccactgttcatctataatgagctgtgcagctcagaacattcttgttcatgcctttccgccatcacttgcatgtattttgatctggtgtatactccagagtggaatggcagggtctgaggggatgctatgttcggctgcagtagatcctaataaacagttttccaacatggaggtacctatttaaagtgtaacttcgattttaaagcaaagtggatgcttgggtttgaacttcacagtcacatttattggattgaaagggctcattggcaacccacagccaagagaccaagagagagtcctaaccatggggagggagcagttgccagtgccctggcatcctggtccccgccctggtctggtgttgggtctctgcagcatgcaaaggggatggccagacaagacacaccgaagacacacctcctgccctctggaggctgattgtttccacaatgacgacaatgatcatcagtattactattgatctttctcctcctcctgtccttctctttcacttctcccctccacttcacccaaaaaaaggagttttattcccatccctcacccagcacacacatgggcgcatgcacacacacacacacacacacacctgccaaattcgtgggaggacccactcctaaggttgggatgcagttgggaatcacagtgtggggaaaagtgttagttacactggaggaagtgtgatgcaatcactggagctctttgagaaaagcttattttaaaaaaaaaaaaaaaaaacaacacagagtaagaatgagtctttccaaaattactgtgtcttgggccaggcctggagacagccctatccctctcttatgctccttgtgcagtgtttgagatgcctaagcccgtatgaagcacaacaggagaagcagccccagtaccctcagataaaagcaacaggtgatgcgttttctaaatagtgcattgcctttctagtgccacctcctgcaactggggatcccactgccagcagcctctccaggcacccccaaggctgtctcccacaggtgggctaggagatggggaacagggctcgctgctcacctgaggacctgcacgggcaactggaaggggccagctgaacacaagaggcactgggtgctgttggagaagagggtgcttcttcgggacatttgttagcccatcagaggatggtgaccccagggtggctgaccctttcttcctccattcacttcagctgggtgtggcagaggagcttggacacgcatcaattgcatgtctgcagggccagagaggtgtgtcatattagcaggtaaccaatttgatccacaccaccctgtcacattgttttcaccccaagggtcctggctcccagcctgagggatctcaaaggtccccctcgatggctttgcctttgagaagtagggggagtggaggcatgggtgaggaaactgcctggacacaacccaggggccctgtgggcagccttggcactagtccagggctgggaagctgccccctcagttctatggccctcgttggactgtatgggaccccatggtctgtggagtgggagaagcacaatctgcggttgtcctgagtcttttctgtcttcctgcaggctgcccaaccccaagggcctaacagagatgatcagtttaaccaggtagaacatggtggttttgatacctccttctgttagtttcttccaaatggccaatgtcttggaaaattctgttgaccagtaaagctttattaataaagcattcattttttcgttttcccactgaaaatcatcatagacccacatgactgccagtggggcttcaggtcacactgcaacaactgctgtgactactagagtttatctaactgtgtctgaaactagaggctcgtgatgttcttgtgagccattgcagcctcaatggtgtacatctgaggttcctgttgctttgaaataacatgcagaccctcaataccacactgtcctacttctagaaggagaagtagctctgaattgtgagtttgcattgtaaaagcagttttctccttccaggagtttccaaattctaagtgacagggaactccagggatagtaaaactctcttcagagtggacaaaactctgtatgtgcagacaggctcaggaagccagggaagccagaggaggtgctgctgcagtaactcatctctcttgtgaaggtggaaatgaaaaaggaatctcagacctccttctgtgggtcacccactgtctctggttagtgagcctgatttgtgggcaggtgagtaattgagggagggaaggaggataggctggggatgaaggttgggttgggatgttgtctctgcttgggtttggctgatcccacagggtgctctggagcacaacaacatcacacagttgatcttatcttgggtcaatgggaccactttttgtagacccagtcagccactcactagcccctggctgcccctcgcatggggcaggggaaatgtgtgactcctaagcaaggcagcttctctggacatgggggaagctgagagccaggagcagccagagctcacagcagcagggtgcatggccggcaagggtatctgcaggcattggcagcaagtgccacgcctcccacttgtgaacctggctggccacgggctaccacctctctcagcctgtcccggtgaagagggttggtctagatttagatcctactgtttgaataagtctctgcagccctgcagggatcttgcagtagattgagggaaagcaaaccaaccatgtccaaaaagaccatgccagtgggcaaagtggagcagcggagatgtggctgttagggtaggacacggacggggttatccagaggtgtggggaggtgtgcctgtctcagacctgtccaagattctttctggatggcatttctgctcagccatgtgttcctgcttcgtccatgtgctttgaggccccagggtttgtgcacacaatactcggggcttgggagtgccccatgtagctcagagctgtccacccctcactccccaggcatctcctctcaggccggggatgcttttctcaggatggcctggccgttttcaggccactcggtttctccatttctccattcttgcggtgggcctattgattaggagaatctcacccagtctcgctttggccggggtagctctgccaggtctgaattcttttcaaaaattgaaaagtacttgtaagtagattaaccgtgcatgcccggggcgtttcccaaagccagcattgacaagtagataagaatgatttataactagcacttcagtctgcgtcagtggtgcttgtggacagataacggtgtcttcggctcgatttcttcttggctgagttggagatgctccttccaggctggtggctctgaattcaagaactctggcacactcagctctcattgagggcaatcgtgatgaatagtgaatcagcttcccctgacaatgggggtcattttactgcaaaatggctgccctttgtgtctctgggaaaagggtgctgagaaatgaatgtcgagggctgtagaaatgctgaataataagtgaacttgatcacatcgggcagcgagtctgaatgcctccctttgatttgacccagttataccttcaaggtcccaggactggtgctttggaaaaagtgactggctccagcacatctctgtgtacctcaatgctatcagatctccatcatggactctcatctcaatagaatgttaagttttgagaataataactcaaagaatttcctggaaaaggcagaggaggtgaggggtgggattgtgaatgggcatactggagacccagctccaagaggaagattaatttagaactcagagggaggggccttggcttaagctggagccaggctgcatgggccctgatgggaataaatagaagccccaggttttgtaggtgtttcacctcattcctttattcattaagtcaatgggcaggtgtgggattaggtcagttttgctcgtattgcatttgagatgtcccatatagattgaggtttgggcgatagaggtttgggttgtgggaggaagcaattctttactcttttcccaagactgtactgaaagcagctgggattgcatctgatgttttccacacgtggctgtaatctgaaagtacagggcagttgtcggtcgtctctaaattcacggggcaagtttgcatccctagttaagtaataatttaaagaaatggttaatcatgaccttcctacagatataaaataaacatgtgttgaagattttctttaactcattatgaatgaggaaactggtaagatgttatagacatttcaaaggagaatccaaagaacggacacaaatatagatcaggagtattgaaatgaatgtgcaaatggaggcaaaattggtttctttcatagtaggggagagaagtcgattgaacctactagacaaaatttgcatgtatagataattattttgcatcactgtcaatttacagagttgtaaaagagctcaaatgcaatgaaaagtaagaataatctggaaaggtgtgctgtaaacaatgcataatttcctgttgaaccacattttttttccttttctcttcttagtaaagttcaatatttttatcattaaacttgttcagaaagtgtctgtctctttaaaatatgtaagcaataataaaagtttcttttttatttgagatgttttatgtctgtttttatgatattaaattttagatagggcttttactctccaaataactctaagagttaatgaaattatcccaggtgatttcctgagacatatgttaatgagtagaaagtatgatttataagattgatgtatattatttgtaagatactggggatatgaataacattggaataatgagtctgtgaccagaataaaatagctcaaacaacacagaagtttccaaagcacaactgttacggggtgggctacaggaggtgagggaataagacacattcagaaacatctagataattccagaacataacttccccaaaataactgcgaatttcttcatgcgttatttttgaatctctgagaacttctagagtgatttaatggaagttaacatttttcctagttcagaaggaccccacagggtagatgcctctatcttgtctgtctttctaaagtttatcctgagaagatgtacaggagaacatgggtaggtaattcatggcagaattgaacttgcaaagcttcttctggtgtaatgtggaaatagttcttcttgacctttctgcagtctttgacattgtggactcagctctcctgttggaaacctatccctcatttccttaaccctcttacagtccctgtttctcatctgctagggctgcttcctgtgtctttctctggccccttcttctttcctccccttggttctgaggacgcagccccaggcaccacgctcctctctccccagagccttccccaagaactgaatccccatgtggaaaatcagccacccaccttgattcagatgactatgatcttcattcatctcctgagcatgattccagtattccccacgaccactggaggtttccacctgaatgttcttacactcgttactcagagtggctgaaatgtagataatcaaatatcttccagtgaaatatagctcccttttaaacgtattctgtcatccaattgtttgacaattaccaagcattgtcaattcttttttctcaatctctctcctatctgacctttcctctcattccattgtcaagccataatccaggcctttatcccttcatcaaggggtcatcctaatagcttctgcattcatcttaattcaatgagcattcctttagtgccttatgagtagataccgtgaaccaggtgctgacgtgcctggtagggctacaatgccgagaggctgctgggaagacagacatccgttagatactcacactgttaagcaactaatcataaactgcagtaagtactagaaagaaggtgtggtgagaacatgcagtggggagctggacattagcctctagggccagacacggcatctgaggaatgaagagacatgacatacatcaaggcgaggtggaggggagaatttaccaggcaaagtcccagcgctgggcaagtctatggggtggttggaggcatggcatgtcagagagactgagcatgaaaggcctgttgctagagcgaggtgaggtgggagaaggcagcggcaggccggcaatgtgaagttgaaataggaattcaggtgtctatcctcagggcagaggcgagtctttgaagggcttaagcaggaagggaatgacaggatcaggtaagccttttctaaaggtcattgtgactgctttgtgatgtccaatagacaagataacctgaaaatcctcctgatccaaaacaacaggaaatgctggataatatcacagcagagctgaacttagaagcaggtgagagatatccttggagctgtaaataaagaggaagctgaatacccaaggagcatgttgtcactcactactgcatctctcctggtggcatttgcccatctcagtaaacaagaaatgtccgttttaatgactgcacaaggacagaagacaaggctgggggtgaaagtgggttggggaattggatctgtgaccctgccatgaaagaggagccttttgattaataaacaggggactgtatggtaaatccgcttctcacaaaataaaatgctagaaagtttgtctcttttgatctgggctctaggtggggctgggggagtcttcttaaaaaatatcttatcgtggacctgccccaagtgggtttggagttctttacactactttcatggtcctggaaacctcatgccaagaaattaacatattatagtaatggagttcacactggtcatcagtgcaggattcctagaagaagaatggaaattttctctgaaattctcagtagaaatgaactctaaataacttcaaataataatattcatgaatatttatataaaaagatattttaaatatttcagactgtataaatcaatgactacataagtgtgatcaatttgagttggcggtcagaattatgacattttaagtccctgtatttttgaagaagacagtcaatatagagtgaaatttaattttattaaatgaaacgtttgtgttaaaatttatggagaattactaagataatacattcacaacacaaaggcacaaatggttgaaaataaaagaatggaaaaatatgtagtaggcaaacactaaccaaaagacaccattggattaggttggatattactatccaataaagttgatttaagagcaaaacattattatttgagacgattttaatgctaatggtaattttaatggtaaatggtacagtttactgggaagataaaacaatttaaaacttctaaacatttaataacatagtctcaacatgtcaaaaaaaaacttcaccagaaactgaagatataagaagaaacaacaaattttttaaaatgacaaatttataatcagattgagagattttaatacaattttttggtaactgaaagatcaaataataaagtctttaaggtatagaagatttgaacaatggtttgatttgatggacatatatagaactttactctcaacaatatagcataatattttccaaaatatctaagaataaaacatgtgtaagaattcactttgtacgtggccataacacaagtctcaaaaaatgtcattgaatcaacatcacaccagttaaattatttgactacagagagacatatatagccttatgttgaatattgtatatattatcttatgctttattatatcacagtaaaggaagactaaaattaaatatgctaattgttcagtgtgataagttagaagaaagaataataaacctaaacaaattagaaggaaggaaataatatatatgagtagaatcaatgaaatagaaaacagctattatcagtggaatggtcaaaactcaagttttgttcattatgaagaacagtaaaatacacagattctttgacaagcttgatccgcaaaaatgaataatgttagacaagaaaaggaggatataggtacagctatagcagagattattaaaaagataaagtgactcttaccgacatattaggcaactcagatgagattgacattttttctagaaaagtataacaacattgactgaacaagaaatcgaaaatgtgaagagatgtataacactaaaaattttgatcagtagttcaaaatatgtttatttaaatctatgatgtaatttatctcatgaacagataaaaaagaacaggattatttcaataggtgcagaaaaacatttttaaaatttgagcctattctttgtctctctctccctctatctctgtcttctatctctatccctttctctatctctatctctatctccatctctgtctgtctctatctctatctgtctctatcttgttgtctgcaaagcagggctagtagggagtaaagagtatttatcaaaacctgaaagtaaatataattatcaattaagaaataataaaagcatttcctttaaaatcaggaacaggcaagagtgatcattgtcatcccttttaatcaatattttatttgtggttataatcagcgtaataagtcataaaaggaaagtaaaagcatttcaacataagaagtacatttgtttataaatacgttttttaaataaaaaagaatataaattcgatgattagagttagaaacaaaatcagttccatatgtacacgtcagtcatgaatagaaaagtacatagcgtttagaaagcagggccaatgactccagtaggctctctgatggctcagtgaggcattgcctggtgagtgagccttccattttaggtacagaaagaattctgtgtgcaaattatgcccactctcctacctaccctcgcgaaagttacttgtaaccccagttactttgcataatatttttttgactaaaagaaaattatgaagaaaaaaattttaaatcctatttctgaaatgtcttccactctttttagtgatctatgactttctcagaaaactcttttggaggaaagggtgtaatcctgaggtagtaatgttgtggataaaaatatgaggctcatagccactgaaatgctcatttctagaggcagcagacagttcccaattctctctggtttggtagccaacaatcccgcgtagatgatggagcaacttgaaatgtggaattgacatgtgccttaggtataaatgctcatcagattttgaagacttcgtacaaaagaatgtgactatttccttattaattgtatattgagaacatgctgcattgataatatttttgatatattgggttaattaaaagttactacacttaatttcttttagaaaacttctaaaatgtgaacactagaaaatttaaagttacatatgtgatttgctttttagatgttttatatctacttgatgacactgttgtaggtcctccaattcctaattgtgtggtttggggttagtgcttaattttctctcagcctcagtttcctcctttgtaaataagtgagataagtgtgtcctctaccttagatgattgagagtattccatggagaaacccatcctttaaaagacaacttgctaaatggtaaagctttataaaacctacataggtttgttgtttcttatttttcagtccatttttgttccagagcatgacatagtcccaaaaatagaaaaaaacaaaacaaaacaaaacaaggtggagggcttggagaaaatctaccatgtttctgccacgttgcctccttgtgggagccagatgtcagaaccaacctctaggcaaggttttgccatttctcttctactttcaaagagaattctgtgtgccccgcatcccgttcatcatgctgcagtagtacagaattgtaaacattaccatgtaagctgaaaatgtgcaatatcatctaaataattaataaaaaaatgacgatggttttgtaaactttaacattttttctcaaatctttaaaaactctcttagtattggttataaagcatagtaaagtggaaaatagtgaaactaatattcagtcagtacatttaacagaacatttgaaatattgacgtggagaaaagggaaccctagtacccttttggcggaaatgtaaatgaatacagccattatggaaaacagtatgaaggttcctcaaaaaactaaaattagagttactatatgatccagcagctccacttctgggtatacatccaaagactttgaaattggtatgttgaagggatatgcacattcccatgcctgttgcagcactattcatgatagccaagatacggcagcaaccaaagcgtccatcgacagatgaatggctaaagagaaggtggtgtatatatacaatggagtactgttcagacttgaaagatgatgtcagttgtgacaacatggatgaacctagaggatattgtgctaagtgaaattagccaggcacagaaagacaaataccgcatgatctcgtatgtggaatctaaaataaccagacacatagaagcagggaacagaataatggtttccagaggctggggagtggaaggaatgggcagatgttggtccaaggatatgaagcttcagttggacaggaggataaatgataagtatttgagataacgaatatgtgaattagcttgatccagtcattccacattgtatatgtagatcaagcatcactttgtatctcacaaatagatccaatttcaatttgtcaatgtgcagttgaaaagccattataattttgagaaccaaagtgttttatttctttgtaaaacaaacttaccaagagtagtttgaacagtgcttatgatgtggagtgagtatctttcctaagccctggcaagcttccgtactcctaagtttggctcagcttccaacatcttatcttttgtgctctcagtgtcatgaaatatcttcaagcatttctttaagacatcatccttttcctcaagaccactttcttcatttgtgttgtttgtcttcactaattcctgtgtctccaaatctagagtgtctgtacctcaggagtgtcaacatccccacggtcagctgcttcttctctagctccatttatattccattcacatttcatttccagtgtgaacatatttcatttctttgcttcactttcatttcatcttgttggccagttgtttcttttggtcatctgtcttgtgaaatgggtttatcgctgggagacaggaaggcaacacaacttcacaatttgctgtctattggtggactgagtaactgatgcacagtgacccctggtgactcactttgaaaaaaaatcagcatgttagtcatggatcatggtgcacatgttaattgcatgatgatttgcggactgaagcattaggggcgaaatttacacttttagcaattacagttaatataccgtgctaactgaaacttgtacagtgttactggggcactaaattaatgcctacagaactatgccaagtgaagactgcctatgctcagcattttcagacagttgttctttggaggagtctttgtctcttgtcttttgactgatctgaaaggccatctttcctatttgcagtcctcacatgctgtcttctgagcattccaagtgtacagaggagatgtgcaggggtcagcagtcattcagccattcaacagccatgtgtgcagtgtccacgctgtgctgagctcagcactgggtgctggcatatttgctggcaatttccagtgccttaaattgctgtcatttttggcttttggcagctaactttccgacatattttccaaaccactgcttatacaatttgcacaaggttttaaagttacctctcacttgcacaaatttccactatcttgattgctgggatacacatactgtcaggagcatcaggttcctccggttgggatacagtccccatcttggcatgccaaatggggcagtccctttttaaacagaacaatcagctaatggacacagtctaaacttgcatagttgctggttaattattcaaagcatgtttcattaaagccagtcccatttctcagcatcttctttcttcagtgtttttaattgacctgagaattaccatactctgaagggtgtgccaaagaatcagatgtctttgcctggagcattaaattccactgaaaaactacttcaaccagaagagaggtgtggctagagagagaggttcatagttttagagctttttaaaaattttttaatccttttgagattctttgccattaaatatattaagtagttttggaaaataatgtgtttgcttaagaaatccaaaacactttttataagggagctccctggctcccagtggtgaagggaaccaaacgtttatggatctgggagtgtgccagggactttcacatatcatcatccacaatcctcataatggccttataggatggaaattgttatcttcattttcacagttgaggaaactgaggcctagacaagtaaattaagatgcccaagatcttacttctgtttgatgttagagctgaattttgacgttttagtttgtcccattccaaaatcattatacttttccatatataaatgattgcaaatgtctgacatgccagccaccactcttccattctggtaccattacagacatcactaattgataacctatgtattcaacctgacttttgtcatgcagctgcccatgaacgctgctcagaatggaaaacccagctcaccctctaaatggaagataatgtaagcaaagagattttagggtagcactgatacaagcttttaggccagtgtagccactcactgatgttgggttggaggtgcccctccctcatactggcattttcttatgccctctatttctacattagggatagtaagagagcactgaagcattccctgtggaagaagccacagacagggaagaaaagtaagaacttattaatttaaattctgtctgtttcgccagtgtcttggtttgggttcctctagaagcacacactcagacaaggacttgggtgcaaggaggtgacctaagaagcacaagagagagaatgaggtaatgaaacagagtgaggggaaaggcagataaaggtgcattcttaagcagaacactgcaggggacaacgagggcccagctctagccggggtctcagagagtctgtggaacaggcttcagaattgtcccacgagagaggcaaggaagccagggtattgatccacctaattcagtcctctgcaggttgagggttgctcacatccctccactctcctagaattaaatcttatctgcctctcagtttgtctgtgctggtcctgcagaaagccctccaggaggagctgggagactccagccctggagttgaggagcagtcatcaggacactgcaccagggcagccggggtccccaagggggcatgaagggggcccctccagtatctgtgtgctctctagctggctctgttgggtaactttctctgatggtgatcagagttaagttgatcccactgtcctaactttagaaaatcactgagattctgtatatcctgaacgccacctaatgggatgtatagaccacagatggcctttctttgtggccaggctacattctcagtggttgcagcccagcagcatggatttgaaatttatggtggtggttgattccaccaaagacaacacagagtgttgtgtgtagctcttagtaaattccttgttatcttttacaaccatctcgggcaaatattgttcctcttgacagagtgggccatgttagccagagcaaatgttaccccagacaaccgtgaattgaagatgaaagaggagttgcagccagaataactagcttggaaatggagccagtctttcaacagcagaaggggcagataggaggcagggtgaactcagacaacctttgtgctgaagagaccctttgctgtgtgagggtctaagcagttgctggtagcaaaatttttgccaccaaggcttggagtaagaagaaaaatcatggtggtgacggagtagcaatatacttgtggtcataggcactaattaacccagacagctgattttaatcattgctgtcatctgttgcaatcagctagctgacagaggggttgtttcatcttttccaataagtgaatattcaaagctgttctcttttctctctctttcagcttaaaaaaacaaaaagcctgaaattggaatggcgggggggggtgcctgttccagaaactccttgcaattgcccttcagtcatcttagtacattcatttgtatgtgactttgtctcactggattgtgtaaactaggcagggaataactccgcagatcttactcaacaactcccatgatataaacttcttgggatcctccagtgaagcctccagtatgggggaggggtcagcatgtttagaatgaatgtgtcactagctctgtgctaaattctaaagagacacatagaagaggtggtgcttgatttcacaatctcatggtacagctttgggtgcatttagatttatataattatgcaatgggtgcttcgcctgttggagtgaagcaaggtcatgtggcaacttgtggagcaattcttggacacttgggcttcccacggggttaggcaatcctgctgctcctaagtgcccccaggcaacagacgggatggtatcatttatagaaggcatccagctttgggccggtggtctcatctgccatttcctataggagtaggtagaggaggggacagacctaaagactcacattctctaggggtttgttgggatgtcccagggccctggcacatcctggaaatttcaaccagggagtgcaaatgacctgccacgcttggttgcaggaatctgtcattttcagggcattttcgcttcaagagaggcatgaaattgttttagactctggggtctgatgaaggtgtgcgcagcacaggctcatgttgcccttgccaagcgttacccctgttcccctcagggcctgagatcttctgagcagtcaaattggaatcctctagacttccccaaccctttccatgttgtatttgcttctggcatttgcttctcggattgtttcctggttgttaattttgagtcatcagcatctttgcctgtagtatccgcatctgtacaccctccgtggccttctgaggtcttggcatggggttgaccagtgaggggctgtgtgaagtcaccccactgttacccccatcctcacaggtttcccataggctcttctaatgttgcatgagaacctattgtgggcctaacccagtctggcaggaaaaggagagaaggaaagtgcatggaatggtcctgtccttaaagagcttctggaggagatggagaaaggaggcattcacatgtgagatgaaaacagcaaagcaagacctgacaagcttgataggcctgatgagccaggccacaccgtcctcttccatggtccagtctagtgtgcatgttccatgtctaaatcagaggacccagtgggagacagtagggtgtagtggaggctgtggtgagcacaaaggaggttttcctgtccaacatgaggtagacgttcccctcagggcttacatggcatgaactctggcccatgttgccaggtcttctggtttttaagagaaactggaaatctggctctttatatgaaattggggattttttatgacattgtatgaggaaataatcacgcctgtgcccatattcatcctgactgtagcctctgggctgtgccatcctagtgtgctcccacagagtgacattgcccaggcggccatctactcccgaccccagagtctggcttcatttgtgaggtcacctcacatggtccaggggttccctcacaagtcacaggctccactgaatgttcagtgagtagaggctggggagaagagctcatctgtggggacgcggcctccccacgctcactacattgcttgccacctcaagggaagatttctgaggctgcatttcaggcacagatttctgaggctgcactcaggttgggtaggcacgttttggggacaaaagcagtgagtccaagtgttgtagagtctgtcattcctcagcaacaaactcagcagctttccttccagtttaataaatccagacccttgtggcttatataacacgcgtgatgacaagtaatgataactcacgaagaaaaggaagaaaactttttttgtctttctgactcatgcctctagtgtgggaaatctggtcagggtggccacacatgttccctggagctagaaggcgagattccagaggacacacagcatgggctgggaggtcttttgcttccaccgaggaagatgagatttcacagggaagggtttcctggagttccaggtttctccagggcagcatggtggtcaggaacctgcatcctagagccagattgcctgggttcaaatgctggctgcaccacttactagctctgtgaccttgagaaagttacgtaaactctctgtgccatacttctttcatctttaaatgcaggtaatgagaatacctctcacacagcattgttaggactaaagctgcttccagtactgtatacaaaaggaagcatgcatctgccttgccctttcccagaagtagtaaatgtttttgattcactgggtggggatccatgtggcaatattatttataagggatagaagttcactgactgtcattacccaacagacctcatctacccaggcgtgtttgtacctcatctccagggctaccctgcaaagcaggagatgtatgtattgttcctctgccaagagtccccaggggagttgagtggcttatcacggtgacccatcagtttaactcttgctgcctgtcagtggtggctgctgttgagaattccctccgctataggatggagaggtgctctctttaggatgatcgtggctgggctgtcccaatccttgtcccactgggcctgtgccctggttgaaaaccaaagatgattaagatttggagtgtcgttgagagagaagtgtggacttccatggatgtctgtttagccagatggatttccatctttgtcctctccaggtggcccaaagcatgggtgaagaggaagcatggtgccactggatggtcccaggaatgcttgggttcaagctcagatggagccattaactggcacgtggccttggggcaagtcattgtccttccaatgccatacttagtttcttaaaaagaggtggactagatctgtgctgtccaatacgggagccatgagccacacatggcaaccgagcacttgcaatgtcgcttgctagatgagatgtgctgtgagtataaaatgcacagtggcttttaagggcttagtacaaaaaagaatgaaaaataccccagtaactttttatcggtcaagtgcagtggttcatgcctataatcctagcactttaagaggccaaggagggaggattacttgaggccagaagtttgagacatcctgggcaacatagtgagaccccatctctacaaaaaataaaaataagaattagctgggtatggtggcacgtgcctgtagtcttacctacttgggaggctgaggctggaggattgcttgagcccagcagttccaggctgcagtgacctatgatggtggtactgcactccagcctgcgtgatcgaacgagaccctgtctctaataataataataataataataatagtaattttttatctacacagtagcaatgaaaaggaatggagcactgatgcatgctgcaacatggatgaatcttgaaaacattatgatgaattcataagcaattcagcaaagcccacatactgtacaattccattcatatgatgtgttcagaacaggcagctccatagagacagaaagcagtttcatggttgcctggggctggtcaagagggtaacagggagtggctgctaatggatgcaaagtgtctttttggggtgatgaaaatattctaaaattagatgatggtgatggttacacaactctgtaaatatatgaaaaaccatttaattgtacacgttacatgggtgaatttttatggtactggctgggtgcagtggctcacgcttgtaattccggcactttgggaggccgaggtgggcagatcacttgaggccaggagtttaacaccagcctgggcaacatggtgaaaccccatctttacaaaaaatacaaaaattagccgggcatggtggcatacgcttgtagtcccagctacttaggcggctgaggcatgagaatcacttgaacccaggaagtagaggttgcagtgagctgagatcatgccactgcactccagcctgggtaacagagcaagacgttgtctcaaaaaaaaaaaaaaaaaaaagagaattttatgatacttaagctatgtattgataaagctgataaaatagtttttataattattacatgttgaaatgttaatattttggatatatcaggttaggtagaatatattattgaaattaatgtcacctgtttggttttactttttaatatgtctgctagaaaatctggaattcatggctcgcattagatttctgttggactgctgcaccgaaccctctctaaggaccttcctagttccaaaattatattcttccacaaaacgatccctaggtttggacttctgatgactcatctggtatcatggctatgacccaacttgaaaaaagttcatttgggtctttttgaaaaccatttgcaaaaataggtttttaaagagaaatcctgaaaggaggcacagagtcacataaggcgagcccaggagctgggaccatcactttctcctgcctccgtaagcagcctggagccatctacagctgtggatggggctgtttcaaaaaatctatagtctaagcctgaacagcggtttccttaatcgatcctcctctcagacggttgactccgctgagactggccctgctgggcatcaggcccaggagaatgggcagtaaattcccagctggcgtcagccaagaacaggtgcttgggtttctcatatctttatggtctggggggagaccagggaggtgcctttgaatccccaaaaggctcaatgtcaaaacacaaatctcggcctccagttgtacctccaaggagggctcaggatgatgttgggaagcatctttttaccttagttctcctgcaggaattaattaagaatgcctgttatgtttcctacctttttctgggtgctggagggaaattcagaagtctcacttatatctcttttcagagcagcttgactcctgcaagaaccagagtgtgttcatgtccataaaaaccaaatccaaccaaacaccctccaaactcctggatatggtgtgtatttccattgggagcttgagtctttcctgtttactccttctactgcttcttttgatttttatatttttagagatagggtttccctctgttgtccaggctaaaatgcagtggggagatcatagctcacagcagtctcaaactcctgcacgtaagccgtcctctcatctcagtctcctgagtagctggaactacaggcacacgcatcactgtgcccagctcacctgcttcttaaaggctggtaagagtctgagccctggggctgtgagcctttatcaacctctgttttctgcagcacctgcactcaggtagtttcctgtttggaatgccgttcctaaactggcttacctcccttttcacctgttttcatgtaaacagctgatagaagcaccgccatcctggggaggcccagctgcaagctcctggaggcgggcacctttgctgcctctgccctcacagctcttcttcccaccccatgagctcttcttccccattccaggctttgggcaaaggcaaggggaagagagcttttggtaaaagccactctgaacatttttccagaaaactgggcaaaagcaaacttctttgggtactgggcatctttttagatgataattagaaatacagaggaatagtaataaactataatgatggtggggtgccgtggctcacgcctgtaatcctagcactttgggaggctgaggtgggcggatcacgaggtcagcagttcgagaccagcctcaccaatatggtgaaaccctgtctctaataaaaatacaaaattagctggttgtggtgcacgtgcccataatcccggctactcgggaggctgaggcggaagaatcacttgaatccaggaggcggaagttgcagtgagctgagatcgcgccactgcactccagcctgggtgacagagtgagactctgtctccaaataaaagaaagaaactataatgatgaggcagatataaaagtgaacattttcctgtggcttttccaccaagcactggcttttcagagaactccagagaacaagcagcagacaggcagcttgtgcagggtcgatcaagcacaagataaggccagtgtcttcaggaatcagagtggtttgtgagacacttaagcaaattgcattcaggccctatctccttctggcaataattcaccagagaaatgagccatttcactagaagatttccattttaatattagcacagggacaagccttgtttcacaattaaattagagccaggtaagttttctagtaatagtgatatctcgaggaaggattgaaaatagagctgctcagagataatttgcttctgagccaagttatttcatggatctcccaggaggacatcttgctggtatggctttgctactgaggggaagccctccaagcccctctgatgaaaagataagtcacactgcaggtctaagaggaaatgaaacgagtgtgcagcttgagagacagcgaggtgctgggacactctgactccaccgtacagatgtctcaggagcaaaggacccagcatgcaggagctttccttctggaatgggctgcttccgtccgcctgacacctctaggatgttgtcttgtcaacagtagatgtttgtcatatgcttggccatgtgttggcaccatgtcactctgctggtgacagttcaggaccagaggcctttaatcatagtagaaacagtctcagaagtggagcactgctgagtggcagcgacacctgaagattggcgaccaggcaaggtgatgtgaccacagtggccacatggcagccagtcatggccacccctggaggggttcatggaacacatcgagcttgaccgcagcccttgctgttgcattgatctttcttcttatcaccctcagatactacaagagggtgttatcaatattaatgtaccactgagatattggaaacattgtttctcccccaacattatatatgaaaatgttcaaccatacagaaacatcaaaacaattagacggtgaacattcagatacccaccaccaggatttcaccattaacatttcactctatttatagttttttccccctgtgctatgggaaaatctctttttaatgtttctatcatgttttccttttaacaaagtaggtctctccctcccatgtctcagatggaaacattgaggggaagatcatgccaaatacatagcatgttagtgaagccaaagaaaaagaatccgtatgccctgagattaaggtagcaaaatattaagggaaggtctctggagtgggatctggaaggtggataccaggcccagctctgctgctgcacagcctgtgaacctgaggtgatcaacttcatcattgttattttttctttttctcttttttcccattatattcaagatcacctctattctgccaggatggtcctaaggctgacattgggctaattgttgcctgcagtctagtcctatgcagagataacaggtagcctgcgacctttggcaagttgctggactcgattctgagctattgatttcttcttttggaagtgaggataacaacacccagctctcaaagctgttgtaaggttaagtaaggtgttgagatgcaaaaagaaagtactcaaaaccatgcccggaatgaggtcagcatactcagcatggcaaatattatgactcctagtacacatattcccttgccagtgtccagcacataatctccctgagggtaaggtaagcactgctgaagttagagctgtgttgtatttagaaataataatagtagcaagagcagcagttattgtaaagtaaaactgaactgaaaatgaaagaactcgagatacaatttctcagttcacaacatgtgcatcctctgcatgaatttgtgaaaagaactgctgcacttgtctctatagaagagcgtgtttggtttactgcttcccaaaaaagattgaggctatgagactgctgtcctcctctgccaccctttgcagaaggcctgcgaggcatcattgctgtaggcatcattctcagtatgagatgtggttactggagctctgccttcccaagttaggtaaccccctccggcatggaccgacacgctcctcttactcagtgacttcctgtttatcatctggcggtagacagcctgtcattggagaggatgggatcaggtcgagtcacagattcaatgtgtttctaatgggaaaccgaatcagggttgccttggaagcaggacatggcaatgaagactttctatagcccctcagaagccccagcccctcctcatgaggctcaacccttgcttcaagctgccttgcaaatcagacaccacctttcacagtgccttttctggcttcactgaacctctctgaggcaaggaatccccttggaaagatgggaatttattccagagactcctcgttctggtctgtcctccctctctactgcagtttagagctgagaggtgctagagctgactgacaggctgtcctgatggagacatgatgtgaggtaatggacaatggacccccaagaagggggatggggactttgtggtgagcattcattgtcccagttttatattttactttacttttagagacaaggtctcactctcttccaggctggagtgcagtggtgtggcatgatcacagctcactgcagcctcgaactcctgggctcaagtggctcccacctcagcctcatgagtagctgggactacaggtgtgcatcaccacattcagctatttttttttaatgattttttttttgtaaagatggtgttttgctgtattgcccaggctggtcttgaactcctggcctcacgcgatccttccacctcagcctcccagagtgctggaattacagacgtgaggcattgtgcccagccttactgcccttcacaaaaatatctgtgtccaagcttgctcatatatggaacagtccacacctgtgtagcgccagcttccaggaagaagtttatgcattcgtaaggccacgtaggtccgaaagttgcagagcagtaacttaaaccaaagtctggtgtttctcatgacaatgcttatatcttcttaacaaaaggcttaatctgacatataagtcatgaggcttcacactgtcaaaaatagaaaacaatgcaaaatgcttgatgtattggagatttatcagcagctgtttctgcagggagtgtgggtgtcaaggcaggtaggatcaatgggacagtgatgtcatcaaggacccagtgttgttttctcctttccctcccttccttatgttagcatcattcccaaagaagcttcctccatggtggcaaaatggctgcagcagttgcaagcatcgcctctatacacagaaagagagagaggccgggcgcggtggctcacgcctgtaatcccagcactttgggaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaagagagagaaataggacatcagtagctctctctgataaagagggctttattctcagaagccaccagcaaacctcccctaccatctcattggcaggaatggggccacttacctctccctgaaccagtccctttggtcaaggagatgccatatgctgattcccccaattgtgctacaatgatgatggcccatccctggaactaaggtaaagtcaggccaccccttctcccctttctccataactttctgctgctactcaatggggactggtggaagggatcttgagaaaaagacaatgtgtgtggtatctatgatggggacatttactaatcccacccactttacactaactactgctcttgctcttacgattatttctgaatgtaatacagctctaacttcagcagtgtctaccctctgtgagattgtgtgctgggcactgacaaagctgcgtgtgtccttatagtcacaatatttgccccgagccatttgccctttcaccacccactcatcctgctgccatggagtgaccgtatgggattccagaagagacagacacgcccctttgttcctagaatccctcgctccatcacccactccagcctttgtgtgtgtgtgtgtgtgtgtgtgtgtgtgtgtgtgtgttttctgttgacccccccacgtttgttcctgtttctttcacttttagaaacaatggaaaaggattttctttctggcttcccatcagatgacttgctgaccttggctggtagtggctgcaatgagcagggtagctcacagcattgagaagggaacagtctcatgtggctttggagagagaatgtgggctggagagaaggaagcagaaagccacgcaaagagcaaactgtgaagaatgagacagaagccctcagctaggggcacacagccaaacctacatgctgaatattgcttgttttcaaggggggacgttattggaagtctgcacttagataccagtgctccttgtcaggagtctgaaaaataaaaaaagcctgattatttaggcaaatgcctaatcaattagaaatataggggttcactagggatgagagtgagagaggcgttgctctctggctgaaatatgcaaagcaagcctccccgtttctcaggcgcaggtggtggccaggaaagtcctgcttgcatcaacccctcctggtctgactgagccacatcctctctcctttccctgccttcccttacctatcagtggatctcagactctgggctgaaactgagagggcatggatctatctttctttccattcaaccttgctattctcctattgctggtttcagttccaacttggaaagttgcaagcaatgggccaaagaataggaaaaagtgagaagaataaagtggctttgtgtttaaacgaaagcttcactgcctatcctcccctcagttctgtctttctcactgtgaggcatcaagaggatattttagttctggtgtcaagttccaatggtgaaaggagaagagagaaacattatcagaaaatctatgggccaggggcggtgatggctcagacttgtaatcccagcgacttgggaggttaagacaggagttcgagactagcctgggcaacatagtgaaatcccatctctaaaaaaaaaaaaaatgcttactgtggtggtgcacgtctgtagttctagctagctaatttccaccactacactccagcctgagtgacaaagcaagaccctgtcaaaaaaaaaaaaaaaaaattatccacttctatggctctggaccaaacacatcttcccacttgttttaagagacattgtttccaagatgaggtcaaggttaccttcagggctgacatcacttggtgtccctcaagacagaccctcggctctcctctggtgccagcctcaggtgccatgggcagttcagtgtaagctcagactctcattgcaatacagcattgccccaagcatacgctatgtgtctctctgcttcctggctcagggccttcctgagaggtgggagccagcttgactcactcaaaagtgcagtctgcccagcactttgggaggccgaggcgggtggattgcctgagctcaggagttcgcgaccagcctgggcaacacggtgaaaacctgtctctactaaaataaaaaaaaaaaattagctgggcatggtggcatgcacctgtagtcccagctactcaggaggctgaggcaggagaattgcttgaacctgggaggcagaggttgcagtgagccaagatcacgccactgcactccagcctgggcgacagagcgagactccatctcaaaaaaaaaaaaaaaaacaaaacaaaaacgtgcagcctggactctggggagtttgtgctcctggagcaaacctcacctagtgaggaacggaagccacagcctcattcttcacgtggacaattctgggaagcattctcaatgcatgtctgagcttccagagggatcctggtcttgttaccagtggcagcaacctttgtaatgcatgtttatatatgcttttcccctttatctgtcttgctttccactttctttcactgtttcctgggattctctccagaataaactacttgcacccaagtccttgtctcagacttggctgttggaaaacccaaaccaggacacctttcaacgttgcaaacactatattgcaacgtaaagcattactgcactactacaatgacatctgaggcttttgtttgtgtgactgagccagcctctgctgtcagttggcccaggctagccaggtattttggggggctaggtgtcaactgtcttgctccaccatcagtggccagccttctccccttgtagcttgtacttgaaacttttatgtcccatagccatcttaattcacaatttccccagggctcttagagctttattactgtgattcatagaagccacttgagaggctctgtgttcatggcatggggagggacattcatgcaaagaaaagaaatagctctctgcacagcagtgcactacgatggacacaggatgaagccaggaagggctggggaagagcgttactggggttctgtttgggatttcaacagactttacatgggatgggatttttttaaaaagtagaagcatgtatcagctatgagcttctcaggtgctcttagaaaaaagccagcccaatctggctcaggctaaaaagggaatacattgcaacatggaatcgaaaagtttatgattagtctggcttcaggtatcaggggctgaaatgtgatgacatcaggaccttgcctatctctgtcctttggtctgactgtactcacctttatgtgccatctgcggactctcagcctccaggctctcctacttccaggttcaaggtcactgggacagagtgggtgagtctctttctgggagctctgctttgattggcctggctcagttacaggcacctctcagaaccaatcattatggcctacaggatgtgggactttggcctttagttcaggcagcatctttgctggtggtgcagtgggtgggtggagcttcctcccagaacaggtagacttggcaggagggaggggtctctcctaaaatgaaaatctgaggttgattctaaccaagggagaggggatgctgggagggggaagtgcaggcaccaaacttgcagtgtagttaacactttaaatttcccagtggagttttattgaatctctcctctgtgcaagtactggggccaataagaaaaaaaaatgatgtcatcaggaagcttatagtctaataggggaaataagaatcatacatagataactgcaatgtaataattgtttgaaggcacatttcttattactctgtgagcagatgaaacgtgctttctcactgttcacatggtagctgctctttcttctcctcacccctagagagtcccgatacttggtacttttgaagaaaggtgttccagtcaggattgtggagaagaaaccactgtatttcttttccctctgcctgactcattggtgataactgtactctaggcatgaattaagaaaagcccagaattaaggaaagactgatttcctgccctgttctataatggcagagacaagacagcctgagagaaaacagcagacaattttatactcatactcataaataaattggactgtttatccaatcacaaaggatggaagtggcagtgattttgagaagccaagtgatgtagagttgtcaaattctactcaattggaaacaaaaaagtgagttttaaagagaactgaagaaacacatttggcaggtttgcaggggcaaatatattagatgtatgaaaaatacaagtgttcggagtatatcaacagagcctgaggcaaggcatatgtacagctggaatggactatgaagctgtgatccttaggaaagtatattttttaagaaattatgtttaagaaatattgtaatatacgttatgtatatatatgtataatgagatattatttttaagccttatacctatctttgtatttgtaaaattttatatttaaaaaagtggtctcaatattacataaacttcaggtcccataaaacctggatctgccccagatttttatatacaatgaaagataaatgtaataggaataaaatagcgatgaaatgaaccatttaaaaataataattatattttaacagaacaaaacgtggatttttctaaactatgatgatgttaatgttgttatatttatggtagtatcttattgagaaaacatgatagaatatatttaaccattttgaaaatattagttccatactttgagatacagctaacagaaggtctgcttattttaatttaaggttgtttattttaagtttgaagtttaatggctgtcctacttgtaatagataattccccaagatatatagatccaaatggaagaaaagcactatgggctataactactaaatcaagatattaaattttcagtttcattcaccaattacccaaagactgttgttaacatcttcccatcttttctgacttcagtagattaatcttgcaacttttcagaaggtgttgcatttacatatttctaataaattgatttataaaaatccatttttttaaaataaaagacattgaattttaatttcaattttctaataaaagtcattgaaactctttgggaatttttaaatcaggttatgtaattttgattccaaatttttaagtggaacatacacgtttttagaatgtactgatttttatcattttcttgatatgatttatcatatgaagacataaaaagtcttgatatttattttcaaaatgctctctccatagagcaaatttctttagaaaagcttactctttcactggttgttaaaaagtcaccttgagggatgtggagcgagggcagacatggggggcagtgtgttttctgaaaatatccgctaggtgcacacttagctggtggccatgtcttcccagaaaaggttagcatatttatatcacttgtctttttatgagagagaaatgcataattcatctctaagttcaacagttttaaaaaattatttgccaaaagacaatcaatggacatgtgcatggtgtaaaaagatttcatgatcatgtccccatctcatttcaaaatattgtaatattttaatatttcaaataatattggcaaatctgctcaactgagcccatgtaaggtgcatcatgctgtgataataggaaagtaggtgagctaggaagggcaccaggtccatcctgtgcttttccttcaggtccctcacctgctgtgggcaacaggtgcacttctattatgtaaattatgggatatgctgacaagtgcactcggtgcaggtgccattgtgaattcatattttaaatattaaataaatatgtatttcttatttttagagtggaatgtgatataaaggttccaatattttctttccaatctccaataagttatgtagctcatcctccagtagcacacaattctgaaggtgggggaccctaccagcttttgaacatattattctaccatagatttaataaaaaagactcttaaagtccaaacgcaaaggaccttagaggtcagctcattcatgctttttaatatccagatgtggtaatcgggctaaagtgattcaacttctccaacagcttaaagttcatgatagatctgagactagaaacccaaattgacacatcaccaagatgacaaatttctgctatcataagtccatgtatcttcccatggggcctcatgtgatttcttggtcaacttgagttgtgtttactttaaatcctggttgggatgcttctatgccatcactatgcaagatcactataccaagtcactatcattcttttggctaaaaggggttaaggctagttttcagtattgatgctcctttccattcttttctaccagtgagactggctggctttcttcttcccaggcaaagaaggaggctagaagaaaataaaagtcagacaaactccatcttctttgtctcatcagaatgtttagtaacctttatctaaaggccattgcactttcctttgtctcctcttgccactgcagtcttctgacagattggggttctgccttggttcttggccttggaataggggactcagattatgggataaggccagtccttagtttagtcactagccacatgtgtctatttaaatttagatttgcatcaataaaattaaaaattcagcttccagttgtatagtcttatttaaagtaaataacagccacatgtggctggtagctaccatgttggacagtgcaaatatgggacattcccatcactgcacagggtccttttggactgcacagacctagattgatcatcatggtatttgggagtttctgcctctcaaatgtgggaaattatcctggggagtgtttcaggagctcagaaggggataggtaaccactcacctaccagatgtgtctctgttaatttcccagtattccctggcatgttagatctcaggccaggtggtcaaagagtagcccaagagtgataacaagtagcatttaactgacaatttctgtctgaaaggcgatttcaatttctaggccagaggcccacattgtttccattaaattgtgggtgcacctgttgccatctgcccccctttgctcttccctttccccttctttccagcaccctttgaaagctgaaagctgtcttcattgtgagacccactgcacaaacacctatacaggttgagttgaattggcttcctgcacttgagtgtcattcagtataatggtagtgggtggggtatggctgacacagatgccccctgttgcctgagaaacgtggttcatttcactctccatcatcaggtgaggtgggcacacaattatagtatttgctcctgaggcccgtataataatagttgagacccagcaggctcattctttcaacgggggttaactgtaggtctacagagttattgcatgaagagaagaacatcctgcatgcataccttcatcatgactcttcttcctgctggacagaacccactaccggtcagaacatcatcttcttcgcttccattcctacgatttctcttccaacggcacccatttcattggggctgctctgtccagcctgattgggagtccctgggattgcttggagctactacacaatgcattgctcctgaacttgcattttcctttctgaaacacagcccagttggggtgcacatttgcatatgcttctagtgactcagatcctttcatgtgtgtgtacattcacttaaaaatgtgtaattgagcccagctgctcaaagtggtgcttggaccagcagcactggcatccactgagaactcttgagaaacacagaatctcggtgcccaccccagacctccttactcaaagtgtacattttaagaaggtccctacattacatgcatgcatgctctttagagtttgagacatatcttagttcaggctgctataacagaataccacagatttagcagcttaaaaaacagcagtttattcctcacagttctggagcctggaagcctaaggtcagggtgccagcgtggtcaggttctggtgagggccctcttctgaattgcatactgatatattattgtatcctcatgtggtggagaaagggctaaagagctcactagggtccctttagcaagggcactaatcccattcttgggatttggtggatgtattctggtcttattacctaattacctcccaattgggagttaggatttccacatatgaatttgacaccaacattccatactttgtaagaagaaaccccatattggacattgtatgtatgtgagtgtgggagagagatagagttagagggggagggggaagagaaggggtggaagaaagagagagagagagatactagaagagaggagagagagaggaagggtcttcatcaggtggggtcagtcaacatccctgagctttgagctactacagattgtgaaacctggggaaagacatcaataggcaaagggtggcaggagagcttttgaagtccagcaagggccagaggaagcggagcctgaggagcaggtgttgccttggggctgagcttgggcccttgaaatacctgaagaccatcacaagaaaggcaggctttgagcagagaactcctgggctcagccctataggtcattagaagaaccacatttacgttatttagtagttcaatggagaaagatagggatgttctgaaaagagaaagctctgaaaccaggatgctgggacttgattttgtgaagccttctgaagcaatttcaaaatgggaatgtcaacctcactaatgatcagggaaatgcaaattaaacccacagtgtgatactaccttactcctgcaagaatggccataattaaaaaataaaaaaaaaaaaagatgttggtgtggatgtggtgaaagggaacacttctacactgctggtgggaatgtaaactagtacaaccactgtggaaaacagtgtggagattccttaaagaactgcaagtagaactaccatttgatccagcaatcccactacttggaatccacccagaggaaaagaagtcattatatgaaaaagacacttgcacatgcatgtttatagcagcacaattcgcaattgcaaaaatatggaatcaggctaaaagcccatcaaccaatgagtggataaagaaaatatggtatatatgcaccacagaataccattcagccataaaaggaatgaagtaatggcatttgcagcaacctgggtggagttggagactattattctcagtgaagtaactcaggaatggaaaaccaaacattgtatgttcccactcataagtgggagctaagctatgagggtgcaaaggcataagaatgactctggggacctggagggaagggtgggaatggggtgagggataaaagactacacattgagtatagtgtacactgctcagatgatgggtgcaccaaaatctcataaattaccattaaaaatcttatccatgtaaccaaaaacctcctattccccgaaaactattgaaataaaaatttttaaaaagaggactgttggcagatacgggagaaagcgtattcaggtggccactcccatgtggatgctgaagtatcttcagcaggggcttaggcccctctccctttctccatcagaacttctgctttctctgtgctgcccgcccagccactgggggtggaaaccatttccctgatccttgcagccctctgccaggcacttgcaggctctgcagcctccctttgctgatcctgccaggagggttgcccctcagggtctgggagcagtaactcagactccagtggtctcagtgaggggccttcctggtcctggggatgttgaagactgcatattgggctttagagatggagagatcaagctgtgcactgtgccgggaactttgaaggcacgcaacaatgtctgtgagtggagctgggataaaataggtaagcacaggctgtcaggcttctgcagaattgctgggcacatgagtcaccttgtgaaaatgcagattctgatgcagcatgctgcctgtctcacaagcttgcaggtgatgttgatgccgctggtctagggaccacactttgagaagcaaggctgtcatgcagacagttttgtccagcaacccagaaaatctggattctgtctcaagcttgccactaaaattcttgggcttatcatttaaacttaatccccaggtcaaggggcatggccctgaggggtgggacccatggacctgggatcttttctgtacgctgtgcctccctcctcccttggtggttcagtgattacccaggtggtagctctaatgaagtgctgggacacaatggctacagcatccaggctgtcactttgggaggtggggagacacagctaagaaaaaaacataactgaacttccctggagcttacaacctgcgggtgggggtcagggacgggtgatggagtaaagatggacaggtttttgtgaaggaagtcctggagggtccaggaaggcttcctggaggaagggcttccctctagaagaagtgggagaatatgtgggctttcccatctttgtgccaccctcacaaccagcttgcctcgatctgcccaacaatcatagcagaatctgcccttgggaccagtttggacttctggctcagggctttggtccaggtgctttgggccatcccttgttcccaaggccacccttgccaggggctcagccagtctcccctcctcatacctaacctaggccagtgtgggcgaggccatgtaggggtcggtgtcatgtcggacaggaaggcaaagggattttgatgggaagtagagaaagagccaggcctctctttgccctcccataggggagttgcactgggactggtgatggggccattctcccagggtgcaagacacaggtgaaccccacagcctcacatcagagccctgaagtcccagctgctggcttagccacccctctccctttctccatcaggacttctgctttctctgtgccgccagcccagccactgggggtggaaaccatttccctgaaccttgcagccctctgccaggtgcttgcaggctctgcagtctccctttgctgatcctgccaggagggctgcccctcagggtctgggagcagtaactcagactccagggtgcccagggatctgctgcggatcttgtgagatgcagattctgactctggtccagccccaggaggtgccaatgctgctcctcctctgactggaagacagggactccatccagaagacagaagatctccaagccacaggaggccataggttctgtttaaatcctcttccatgagctgtctccacagcctgtccaatgggcaaggggatgctgagaacacccccttgggctgggtcaaggtctccctctaatgtccccaactcagcaacgacaatcacaggcatcacctcttaactggtgtaaatttcttgccagtatcaattgagccttttcagtccctccaataggacaggcctccctttaatccaaaggcgaagaggggagaaggcacgaagtgccctgcctcaagtgggcaggtggctagggttgccttctcccctcttcccctctgggttaaagggaggcctgtcctattgaagggactgaaaacgctcaactttcaatctggttttcctcttggagtggaggtgtagcgccttgacactggtgagaaatttacatccagtgtaagagttgatgcctgtgattgccgccgctgagttggggacattagagggagaccttgacccagcccaagggggtgttctcagcatccccttgcccactggacaggctgtggaaacagctcatggaagacaatttaaacagaacctatcgcctcctgtggcttggagatcttctcccagccaccttctctggatattcccttctctgactttctggaagctttgaggcagttgaggggaatgaatgtatggccctgttagcctctggcttcctcctctcctgctgggttaggagaggtctgtttgggggatgtgtggccctgttagcctccagcatcctcctctccttctgggttaggagagctccttttgggggctgcaacctctccacaattggtgctcctttccaaggaccttgaacaaaagcacagggaagctcttgcttcagctggaaaacccatgagaaaaatctacctgtacgaagccagggcctccactgctcccctcttcatccacagagggtgaggacaccaggctcatccttccaagacttcagggggaggggcaggaaaggggtcatttggagagcagtgctgctcactcaagtctgcagaaggcgtccgctggctgcgggcttatgcaaacctgacctccaaccccagggtgaagacccgggttgtacagagtggaggcagctgtgtaaactgtagggtggggtatttatagccttagtgaggagcaccaaaccagcctagagagcctgagttagtgctgccgcccttggctgtgtttcttgtgccgttaactgagttttccagacattctttctccagtgttgcattcggctttacaagactcagtttcttcatctgcaaatgggaggctgttgccatggccctctgagtgcttcagccagatggttctctgcatcccagttttcaaaaagaaaagcagtattccagttcacagggaggggagagttaatacgtcctctcaaaaggagctgctatgcccctaaggccacttccctgggctcctggagctctgggacaggtgagaaacacatacctgagctttgcagtcagctctggcctagggtcctggcttggctgcttacctgcatcagcattccctgcaagaggatggagtgagatggtataggaagggtgcttggcacataataaggggcataaaagataattttgctgatgatgcagcaaacttcctcatctgctgccaccgcggtgtctgaaggagttaaacctcttatcagagagcaggcagctccacctctccaccaggcctggggctagtgtttgggaagggtttgcaagccctgtgggacaaggttcacataggagacagtgttagggtgaaggctgctagtcaaggctgtttgtcagggggcatgcagggagatccattcttggtgtcagaaatccttgggctctctaagccccagttgtggggaggagggcggtaggggaggaggagggaggagagcacaaaagggtgagcacacagctctgtaatggaaacttggcgtccagcctcactttgtgtccttccttagtgcatgcggcttgcttttcgagttgagagcttggtttcctccccttctagccaacatcccgtgctatccccatggcccactcctgtcccctcttcttagagcctgcagtcctgcagactgcctccacccgtgacatgtgacatgtgagcctgctgcctcccctcttcatcccctacccctcccctgactaattaggccaacatgcaacttccagggcctggcagatgaggagccaagaatgccatggacaggggccaagtgtttttgttgacattgctcaagtatagctttgtggagcggcctctttgctgtagcagagaaatccaaggaagctggagaggtgagcgaggggagagcagggaggatagccagtgtgggcgcctctccgtatccccttcaccttcccaccctccaagccttcccagctgcccaccctctgcccctcctccctaagtgcaagaagatagccctccatgtcataatttgtgggaccagcccagtctctaggaaatcacactgagcagagtgagttgcacgcagtgggactttagaagtgtcttatttcttcgtttgtgaacctttcatgggggatgctcgtcctcactgctgttcccaattcagtcacatgtcccttaacagtggggatatgttctgagaaatgcactgttaggcgattttgttcttgtaccaacatcacagaatgtatttacataaatctggatggtatagcctattgctcctaggctaaaaacctgtacggcaagtgactgactgtactgaacactgtaggcagttgtaacacagtggtaaatatgtatgtatctaaacatatctaaatacagcaaagggacagtaaaaatatggtgttaaaatcttatggggctgactgtggtggctcgtgcgtataatcccagcactttaggaggtcgaggtgggaggatcacttgaggccaggagtttgagaccagcctgggcaacatagtgagactctgtctctacaaaaaataataaaattagctggatgtggtggcatgcacctgcagtcctagatactggggaggctgaggcaggaggatcatgtgagcctcggagtttgaggctgcagtgcaccattgcactcctgcctgggcaacagagccagaccatgtctctaattaaaaaaaaaaaaaattgaccactcttatatatgccctccgacgctgacagaaatgtcattttgcagtgcatgactgtaatttctgaggaaacaaccatctttgaaataagaccagtgagacttatttacctcttcactgctagcctattataaggtgcaggctgcattattgagctactttactatagctgtataattaaaccaggatggatttcatcctatcccaggatctaccaagaatttgtcctttgaggtcactatacctgggttcaaatcctcattctgctacttgctcactgtgtgaccttgggcaagatatttaacctctctgcctatcaatttccttatttacaaaatggaactagtatttccatgtagggttttcatccatgaagatgaaacatggtgaagaatggaaaggtttctgcacatcacagacattcagtgaatggaagccatgctaactacgaaatgatagttgatgtagccacggattggctctgatcttaggcaaattgcttatcctctgacttatgtactctaaaagtaaattgaccctagaaccaactgcctcttcctagctcagcaggagttttgtgaggacaaatgaactgtgctataatattgtcaaacttggttctctgtgggaaggaaatggatgcaatgcattgcttcatcattcttcttttctcagactctggtctctgtgttattacatcagccatcagtggtcaaatacacttttgttgagataaaagtttgcaggttttggaatccagaggtgctgccttaagagtctaattcctgaagatattgaatcattatgtttaaaaatcctctaattttctgctacaatagctggctttatttttacatctcttaattggtatcagcttttctctcagaattacggaaccatggaaacttggcatatgaaggaactttggaagtcattggaagggatactcctgcttctttttaaatctttggggtcttcctgagcattaagattacagtaccacaaagcatttctccttgacccagagaacagtggaatggccacgctgctggccacagcatgactctctctttaggtactgtgtagatgggcagatgccgtggtgctcgaccgatattacttggttctgacctcttcaatgccagctggcacagtgcagcttctagcaccttcctgtcattgcccaaggcctttttctgggcatcaccttggacatccatgtggcagattagaaatgctgggggattatgtcctctttcatcagcttcaaccaatgttagactaggagtaggtggatgaatacctaagcttcctcacatcttaggtgtctgagatgcatgtctacgctggcccccaaagctatccagagagatcagtttctagttattcatgatggcaactgacttaaagtgcacctactattagcatttcctgtcctactctgctcttctaccgattcttcttaggatcacctcccgtataaaccaccttctcacaaatccttctctcaggggctgcttctggggaaacccagcctgaaacagaggggatgcccttctccacactttcagattatttgtgataatatgggagtttaaggctactaaccttaacgtttcttcatgaggttttgaaacttttttgtctctgttcatcactattcttaaccattagaatccaccattcaggttatccaaactacacaaatgccttgctttaacctcgaattatctttgatattgtcctcataatctgggctaagctgatacatgtggccgccatgtagaattttgtatttcaagagtctgaaattattgtttcttttcattagactccacatccttcctccattttttggggaaaaaaacctggggggctctcctggatgatatgcataaactgtaatttgatatcttgctaaatttacatgtggaagcagggtctgtgtttgaggaagacctcagttcatgagctactgatattatgtgcatcatgttagcttaggtgaggtgcccacaggcattgtgatttccagacacttccatgagtctcactttctccacctaaaaagtgggactaattatttcaacacatacctactgagtacctaccctgagccagcagtgatcaggtgctggagaggcaatgtccacactctccttctttcttgagcggtgttgtgaggtttgaattcagtaacgaaggagaaatcatttgggaaactgaatcactgtggaagtagaggagagggcagaatgccctccagctcttcagtgaccacttcagacaccgtgttggtgtggctgggtgcaccatgtggccttgtgtgaaggccactgggcccatgggttaggcccacgtcttgtgtttccatccgttttccgcccgcggcaactttggacattcaagaggcagcattgcctcaggtcccttcttcagtgccaagcccctgggaagagccacttttgcagcttggcttactgtctgtgtctccccatggccccatgaagccaggccccacctgtcatgtttctgccttcatcttacctgatctgtccatggtggtcaaggctgttggctacaccttccttcctgaaattctctttctgcttaccttccacgacacctgctttccttgctcttttccttcctttcatgatcccttcctgtatccttttgctctgtctcctctctgaaggatattgtgttcttccattccttctccctggtgccccctcttctccaccgggagaccccattcatatatgtgcctcccacccttccctattgctgatgacttccctgaggcttgctgtggctctacttttctgcccgaggttcctccactcacatttgcagcatttctaatctgccacatggatgtccaaggtgatgcccagaaaaaggccttgggcaatgacaggaaggtgctagaagctgcactgtgccagctggcattgaagaggtcagaaccaagtaatatgggtcgagcaccacggcatctgcctatctacacggtacctaaagagagagtcatgctgtggccagcaacgtggccattccactgttctctgggtcaaggagaaatgctttgtggtactgtaatcttaatgctcaggaagaccccaaagatttaaaaagaagcaggagtatcccttccaatgacttccaaagttcctccctttccgtgctctgtaggctcttcaaactcagcatgccccaaacagaatgcactgcactggccccttcagtgtgctctttagcctgtgttctttcttctggcacctccaaccccacagtcattgcagccctgagccctgttacctgctctcccaacctactgtttcctagttcgtgccttcatctcttgttcattgaaaacatgctgtgtggcactcatgaacctatgctttggggatggcaaattatgtctttgcttgataacccccagaagcagatcctgatgtatgttcaatggtgggtggttcatttgggggctgatttcaggagatactggcaggggctagacctcggtgggctggagccagctcttattgactcagtggagctgattgtgtccatctcttccgaataccattttcaatgatgtcatgtgggcagcttggcattggctacaatgggaatattgacaccacagaagttggccagtggctgcaaaacagggcttttctcccccttcgagatttggttgttaaacatttctcagcatgtcactgggagcagggaattgagacagggaatggggggcagttgatcaagtgtgctttatcaagagagttacacagtagacaactggagcttgatcccactgggaagaatctagaatccagcttagaacatacacctcaaagtcatcccactggtgcggcaaggaagccttcaggcagctagaggcagagtggctgggggtgcaggcggggctgaacaagtgatggctgatcagggcagcgggcatgcagcgtcggcagaggctgaaacccagctgtgaatgatgtgtggttattgtctttgtctccccagagcttgacctcatggacctcgtaggggaagacagaaagtggatgatggcgaggaagctgatgcaggtgaacgacactctgacttccgaagatgccggactccggaacagcaagaactgcaccgaaccaggtaacagtgctgactactcatgggcagcagctgtcattttctctggctatggctgaggaagagccagctgctgtgtgttttcttagaattttaatccagaaagcctccaaagatgtttaggatgggagtctaagaaactttcaggtgacatcctgagggactattaagttgtgttttgacctctgtgttcgttttctactggagctgggggtaagtcagagacagtgacactcctgatgcggtactgagatcagatgtggaggctggtgctgccaagtgagaaaccaaggcaggagcaggatgggtgaggatattttgtggttacctttgctttgattgctttggtcctctttggctggtttttaatcaggaactttgtttctatcacagtagagacacagggattgggccggatcgtcactcacgatgttgaacttcttggaagaggcgaatattaatttattggttgtgagatttgatatctattatgccattccccagaaatatatatggaacattctatctctaatgttactaaacagaaaaagaaaacaaagcagatcaaagggaatgaggagctgtgaggacccagcccaccaagcctcagggacgtgacaggcatccctctggatgaatgaagtccctgaaggtttagacctggagtcagtaaacttgttctggaaagggccagacagtaaatactgtaggctttgcaggccacatatcgcatctgtagtgtattcttaaaataattttttataatgctttatcaatttaaaaagcattcttatctcacaggttgtaccaaaacaggcggtgggatggagtaggtctgtagccatattttgctgctttgacttggacctcgaagctctctggggctttctgtccttgcctggtggggacttggcctcatgtgtgccactgtcaagggcccaggagctcaatgacatgctgatcctacatccaaaggtctgtctcatctttagtgtcagcacggaaggatataaacaatctccattgcagcccaaacaactacaggctgttgagtacagaagacatgtcagagaattgcaggtctgcgatctattgggaagatgggtgggagtgcccttcccaccatacttagactcttaacaatcagctttcaagcaaagctggaaagaattaaaaatagttatctgccctgcctccaccaccaccaccagaaaaacaaaaacaaaaacaaacaaaaaaaataccctatgtagtctatgttcctcaacctggagaatccaagggttactgtggctgttgttccatgctcacaaggagcatttttcacttgaaagtgaagcagcacatgggcagctacgtgagttagaaatgaaaatgggtatgaagggtccaagtgccccactgagggactgaaccacgtgtactttaagaagcagagatttccaaggactagcctgaaaaggcatagcagggaaggcacagcttctgtgccaagaacagatctggtcctgtagtcaaatagttttcaacatctttctccaactaataagctaattaggattaatcagctaatagtattagaaagcccaggtatcacttctggtatgggaaagaatggaatcagacaggacatggtgaccagctctgagcattaggttcagccatatgcagaaccagcaaggatggggggattctgttccctgttgctggggtgtgttttgggggcaggtggttggtctctctgtgagtagcattgctcactgtattgggaaataccgttctcagagtgacagatgtagaagcataaagcacattcaaagtcattccaagagtggaaataactcagcctcacagatagaaaagaaaatgtctaggtagataaaaagaacgtgaacccgggatctgcctgtgttggcaggggccacacagggaaagggaggagaggaaaggcttcaggaggaatatgggaggaagcaaaagcaagctgagtcatgctgcgaaaagcaggtccaaagggaatatggatccaggagggacaatcttgatttccttacctgcagaccaaaagaaccgggcttggtttctgaggcccttgattcagaaccaaattccacaaggaagatgatcatgcctgaaacaggagaagttctgttcaaatcctaacacatcaagggctgggtcagagcccacgtgcttcatgaagcttgcttggaccaccccagactgcagcattcttttctgactgctgctggtataaaatgtctccacatgtgctgttaaatatggacattcaatggcaatttcaattcaagtgaattcaaaccaactaaaattaaatattcagattctcagttgcaccaactacatgtcaaatactcgatagttggatcacagatgacagcacaggtcccaaaacatttccatcatcacagaaagagctattggacagggtggtcagaacttgcagttgtctttggatgtatctcctgtctttccagcccaattgcaaacatctcaagggtgtagagcaaatatgtaaatctgagggccttatctctaccccgggtcttagagtcacactgacctgaagctgtggactttggccaaatagccaggttctcagagtctctgtgtgcttctctagaagttgacatcatcattctgatctttcatgattgctgtgagaattactaataaagtgtggacagcttagtgccctgggtttgatggcactgtagtaggagtgtattcgtgaatttcccaccctctgtcctggggcatcattacgggtggggcacagtgcaagattcctagagcaacattctccagctactccctgcagagcgagtctgtcagcaggccacaccgcaggtagctcaggtctaaacagaccgtcatctagacaggaggcttcagtaccatcttcccatgtaggcaagccctgaagacctcaggcttggcaatgaatgccatcatctctgctgcattgactatttctaacaacaggatcagaacattgccacagacacatgtgagccctggttacctccatgcccttaccagaatgctgtcgaagctggctcctcggtctggactggacagatattttatgaaaaaagttgagagccaaagcacccataaggtcctgatttagaagcatcattttaataatattcatcttctctgcctctaacttgttgttgggtgaaatggttgagcaggagtgaggtgagggcaggttcattctaaaactttgttcagttttccttaagaggccctgggcacaatgaatactacttgtgctggttaaatatagtgccatctgccctcgaaaatcttaaatagagaggctaggaagtgagccctgtggttcctggactctctcccttcctatttatgatgatgtcagcggcagcagtacacttaacagagcctacggagcaggcttccctctgtgcttggaggagtgaagatttacacagggacttgagtgtttggggtgcagtgtgtgtcctggctgtctgagttatggtggcaaggtcacaggcaggagttaatttggcatttgtcataaagtacacccagctgccacttgtgatgtcatggggcttctcagactgtgctgtcagaagccctggctttagatgctattagaggaagcctgtagattcagagactggagacagagttacctctattctggttatattccctgttggggcatgattctggtttgcctctcagattaccatttcctcacctacaaaatagatcttcaactacatttatcccttcccttgcacacatccatttattccaagaaatttcaagaatagaaattcaagaaaacttcttccccttgacactctcccatttcccttaataactgctgtgtttgcagaattccatgccatacctcaagccttcctctactccctctcccctcctccccttccctctgccctgccttctccctttctctctgtctgaaaaccaggagcacagagtgcccagttttggtgccagagaaagcccagggtgctgtcttctgatgacagctgctactttaaggatatattactttatacattttctgctttcaaaaaaatggcactgggcgcggtgactcacgcctataatcccagcactttgggagcccaaggcgggtggattacttgaggccaggagttcgggaccagcctgggcaacatggtgaaaccccatctctataaaatgtacaaaagttagccagtcgtggtggtgtgagtctgtggtcccagctacttggggggctgaggtggaaggatcaactgagcctgggagatggaggttgcagtgagctgagatcactccactgcactccagcctgggtgacagaatgagaccctgtctcaaaaaaaaaaaaaaaaaaaaaaaaaggcatttttcctttgccccttgaagacctagttttggtagaaatttgtgatttttttttttttttctaccttcagaactgcatgaacaagactgactgacctccgggctccaacttttctttgcaattgttccagctctctgtgaatttttaaggttgttttcttagcctgacactgccgacttcatctgaagcctggaaacatttttttttttttcttttggcaagtaacacttgaaattgtttactcagatgacctattaagagaaatttaactttgaataatttgatccatggaaaattaagttagctaaatgtaatattgaagatggtagacaactgtagcagaaatgaattctttgtaatatttatttgtgcactttacagaattttatttatacactttgcagtgtgtctccagaaaaatatatcatcttttggtttttggttccttgatattttaaggaaatgagcttttcctcagagtgctttttccaaataaactttggaagaaggaaaatatttaaaatgatggcctttggtgtgggcttcactgtgagatcactggatttcccttgataaaggatcatcccactctgtctggcttagctgggcctaaggcctcgaaaagtgaagaggatgcttggcctgtgtttcaagaccaaagtcaggctggcagggcactgccctatggggatggccaggagtgcctacaggtcagctattgactggcccgaagcccacagttaacagttaaatgtgagctgcagttgacgagggaaaccgggaagtctatatgagagaagcaacaggaggggaggttcaaggggtgcctgtggtccataaacaagaactggagtccaggcacagaccagcaagcagaaaacatgcgttcagggtactggccatgaacagtgtcaggatcccactgtttggggtttaaactgtgacatcagagtgggctggtttaaaatcagagggctggacatgaccagtctacaaagcatgatagggccaacattgtcatcttttacatgaaaaaaacaagaaccagaggggataaacaaccgcccaaggtcagagggcttgtcagaagtaacatagggccacccaacacccgtgcagtgctcaatacccattaataattgaagagaaaatctgaggtctgcacaatctcgagtagcactgtccagtaggaacaagatgtgagctacaagcgtacttttaaattttctattagctacattacaaaagtacaaagaaacaggtgaaattaattttaataatatgttttatttgaccaaatgtttccgaaatactagaaatgacaaattgcaattaggttaatgtggttattgctgggtttgaacccaagaaagaactaaatttaaagacttaagattcatctgtacattatttcactagcttatgtaacttgaacttctttctgaagttgtaattctcataatgattcaaatcacagctgttgagattcttaagtggaacagatttggaactaatgtgatctgctttttaatttgtatcaaattgtgtgctgaattatttagatagggtaatagtagctgctgtaacagagaagtcctccagatttctgtgttaacacaagagaagtttatttctttctcatggaatgttctagtctatagttgcacctgttgcaagaaggggtccatggactccagaaccttctatctttaggcctttccctcctcaacttggcttccaaggttgctgtgcttctttgcattaaggggaaagagcatggaggatttggggtagcagggttttatggactagatgctcaccgatgctcacattccattggcggagctcagtcacatgacaacctctaacctcaagggaggctggcccatgtacatcagtggaatgtagaaagaagaagaaacaggtttggtgaactgctagctagtctctgctacattaatttcccccaaacttgtttcttctgaaaaagcaaatttcccaatttttctttatgcttatctcattttcaaaagccaaataccaccattatagaaaaatcataacccaaatttatgtctgccaaggctggctatagctcttgctttaatcttcataacaattccctcatcaagtgaaacaattttattctcttttcaccttgtgggggtcatcaatgaggcagaaattgtcccagtggtgccatttgcaaattgcatcttttctttggtaataaaagaaccctgcggaaaataatgaatgcttttgtatagatgaagtcatttggcaattgtgtggaaagaacttgggttctggagtaaatcctaaatcccaactccaccactttcgacctgtgtgatgccaagtggcttcctaaattatttagacctcatttccaccctctgtaaaatgcaaattaagatgccttcttcccaggcttgtggtaatcattcagtgaagtaagctttgcagagcagctgcaaatcatagtatgtgcttaataaattgtagccatattatctttgctgccagaaatacagtggaaggtaggctgatggagatcatttataggaatttaccactctgcaggcacattagaactttgtgggaataagattgttttaatgatgaatagattatttagtgtcattcagcaacaataccacattcttacaggttgggctgcgtgtaggagacatacagtggtattaactacgaggcttctgactaataagtttctggcctaagagtccactatgtaaacaaacaggatgaaatagggagcagaggattttctactttatactaatgaagagtttaaagtctcaggctctagcagaaagggccagacactatttgttttttctagctttgacatccctttagggcatttttattgagacatttttttaaacactgttctttaaaagcagcccaggcagcctaatttggtgagtggtgtctggaatctttctgaaacacaggtaaaggatgataaaactctgctgttagatgcagagattttgtggatctatttgtaaagtcctttagacatttcaaagcattttcacattcattagctcattggaacatgtttggctcttggaataaatacctcaaggtcaggaaaaacggtatgatgatgcccagttgatagattagttagtctgagagcaaagcaagtcgagttaaagaactgagaattcagagtcataaatgcaaaaacaaacatagggattatggtttctagtggcttctaaacccttttcctctaagccagggctcaacaaacaagagcccttggccacagggggcctgtcgactgtctttgtgaataaagttttattggaacacagccacacacatccatttatgtgtttctatggcaacttttgctctatgaaggctgaattgagtagttgcaacacagaccacagggcttgaaaagcctaaaatatttattcttgggcctttacagaaatgtttgctgctgcccctggttccaggctctgtgacagttgcctcatgtgctctgcaggggaggttgaggcaggaatgacatttccaaggtcctctctactctccctgatccttcccccaggtggtgcctgtgccatattgcatatttttaatgtcacccctgggctgggggtctgtgattcaggtactctcccctcctcctgcccccacccactggcacacaatcaaaaaaactccaatatttttcctttcgtatgttagggatctgtttaaaattttatttgaagagtaaaagtttaccccctaaaagagcttgaaaccacgggcctggaacaccccttgctccagagcatctgggtctccagaccacatgtctagtactcattctaccttggaattgctttcctctggggttccacagtaaagcagccacttagggttgtccacctgtactcatggcttgctctgcacgatgacagtttccccagagcttatctcacaggcacccccggagcagtgagcaatgcactcaactgtgtgtagagaccatgggtattacagcggggtgctgggaacacccaccttggggagtggagagcctgcaagagaagtcacctcctggtcccaacacacctctcggctgcactgtggcctatgacagtgataagccacatagtgctgcttcctcctggcctgggagcacatgtggccttggccatgtctctactccctggggttcactcccacccacctggctccccactcctcaatcatttctggagcagcagtgtgcccaggggacttggggctcttttcttcaatctcttactgagattgttacacagataatcttattttgcagatgaagcttcaggtttagagacatgaggggcacctccagggctccctgctagttggcactagagcaaggaccaggactctaaggttgcctgtctcccaaagccttgtttgtgtgtggtcagccttaggtcacataatctgggttgccaggtgggctctgttctgcccccttttaagcgctctcagatgtcttaggaccaccaccaccagcagcagcagcccctgggtgcctgttacaaatgctcatccttgagctgcacctgcgccctactggattggaacctctgaaaggcaggcccagccatctgggttgtaacaagccctccaggggcttgtgaggcacactcaagtgtgaggatccctggcttagctcattggaggcacctgtggagattttaaacccaggtccaccccaggccaggaaaatctcagcctctgggactgggaagcaggtgtcagaggttttcaagcttccagggggttatagtctgagtgtttgtgtccctccagtattcatttgttgaaattctaactcccaaggtgatagtgttagaagatggagcttttaggggaacgattaggtcatgagatcagtcccctcaggaataggatttagtgttcttataaaagaggcctgagagaaagccctcaccccttccaccttgtgaggctagagtgagaaaatgtcatctatgaaccagcatgcaggccctccaccagacaccaagcctgctggcatcttgatcttggacttcccagccttcagagctgtgagaaataaatttctgttgtttataggccacccagtctatggtgttctattatagcagcgtgaacagcaggtgagaatggtggcctgagacccacctcttgcatgggtggtctctgtcaagctggctcagggtagaatagctgggcttgcaaggcctagaatcttcaacaagctggcaaacagatgaataaagggagaccgccagccacatgtaagacaccaaacctgtcttccagcagggtctatgtgtgttcagcactactcccaagccctgtgaacatttgtttcttcactctatcttggagaccacgggttttgtttctaagctttcttgccctgggaaacaccagggtgtgtttcacactagctgcattttaaaatctctttgtattgaagtcaacagggaatgttcctgccttgtcctatttgtgggtctaatcttgccatcgggtcctcagttgcctcagcacttgccactcccacccactcagaagccagggctggccgaggtaacagggcgaggtgcccctggggctgagggcagggccttggggcacatctcccggctgctctctgacactcccaggcctgggtggactctggtgcttcggggtggaatgaggcccagggaggcccaggtaggcctggtctctctccccaaaggctctccaggcctgaggagtttctcagcaggctccatgaacaatgggggtggcctgtctgagggctgtgaaggtcagggatggtctgagctacaccagtgagtgcgctttggtttggtcagaggcaccaagcacagtctatccctggctagtgggccacggccacacctcggtttgtgtgccctggagtaggttccactgaggcccaggactatgttcacattccaccttggagagtaagtttaaataggtacatgtctaggctatcctacggacgcttctgaggttcctgatagagtgtgactcccatttcttttggctgaaatgtctataatagaacaataaaatccttgaactaaagattagcagccttttttagaagctgactcagaacaaaatggatttgggcccagcccagtggctcatccatccctgtcaaaacctttgtgccaggagctcagcctggctccccagccctgggcctgcaggagacctcagggcccactcagtgtccacgttattgggatcagggacactgatatgaaaaaaagaaaaaaggcaagaagctgcagacccctgggacaggctctggaaggagcagaggactgggtccaaagagcaggctggactcagtgaagcttctgtgacctcagttgataaatgggcactcacagtacccaccctgtcttggggtcatgagggaacctttcagatagataaggagaggccacattttgtaattgtaggtacttctgagcagagtgatggatgtagggcctgggcatcacaggcctggggaggacccatgggctgtgggaccctggaccagccgcgtaatctctcaaagccttggttcccttccctgagaagtggggatcattcatgagttggtggaacaaagcgtgtcaagtctttaacacacagccagtgctcagtccctgagtggatgcccattttccaagcacccactttgcaacagtcctgaggggtcctgcaaacggagtctcagcttgtcacacttaagagattgtagttattattcatgctgctgattcctttctctggtttttagggcgtgggagttttctactatgggaggcaggtaaaatgaatttgacaggcactaatactacaaaaacccaggcggaaagtaaaaatagtcttagttgtcaaagcacaggagccagtcacatgaacagcctgtcagtatcaaggtaagcctccccgtggagctttttctggggaacgggaattccacttctgctgaaatcttgttgacttgccctgggtaaatttatagaaaaatcacggatgatggggattttggtctgtaggccgagtatgcaggctgggtgtgtagaatggatagcagtggtcgcagggatgaggttgagaggcagaagcaggtgggaaaggagggtttgatctgcacttgactgaccttcttgtcgtagtctgctcaggctgctaaaacaaaatgccatagactgaatgtcgtctaaacgacagaaatttatttcttacagttctggaagctggaagtccaaggccaaggcactggcagattcagtgtctggtgaggacctgtttcctggttcatggttagcgccttcttactctgtcctcacactgaggaaggggcaagggagccctttggagtctcttttatagatttagtaatcctattcttaatcatcttcccaaaggtcttacctcctaatcaccttgccaaaggtcctaccccctgccttgggggctaggaatttagcatgagaatttggggggaacataagcatgaagaccatagcacccttgcatccgtaggaccattgaggtgggaggctgccctttggacaatatctttccacattccagcaacacagtttccccactgcctgctccattttaaccacaaatactaggccaatttattaaattgagttatttaatactgaatttaaaggaaggagagttgtaacgcagctgcacctccccactctcagccatttttatccaattgccctggtttcatgcaggacattggcccctttgtggaatcattttatgttcgtggctcggaaagggatgtttcctggctgggcatggtggctcatgtctgaaatcccagcattttgggaggctgaggtgggtggatcacccgaggtcaggagttcaagaccagcctggccaacatcgtgaaaacccatctctactaaaaatacaaaaattagttgggcgtggtggcaggcacctgtaatcccagctacttgggaggctgaggtatgagaatcacttgaacccgggagatggaggttgcagtgagccgagatggcaccactgcactccaacctgggcaacataacaaaacttcgtctcaaaaaaaaaaaaaaaaaaaagggatatttcctttaaggatgcccaagcaaaattactcagtgcctggctctgcttagtggttctcaggaggacagaattcctcagtaattcccactataaatatagaattactgtcccatcaatgccacaattcgatgtgctgtttatttaaaattttgcttcctctgtctcctcattcagtctcaagaatcttgcctttaggtccagtggtcccttggtatccacgggggattggttctaggacacccccccacctcagaatatcagaatgcatgggtcctcaagtccctgatataaaatggcatagcatttgcatataacctatgcacatcctcccatacactttaaatcatctctaggttgcttataatacctaatacctaatacaatgcctatacatcacttcatttacgtggattcaatgtagtacttgagacgtggcaaatttaagttttgctttttggaactttgtggaattttttttccaattattttttaatggaaaactctagcatttattcataaaatctataaatggaaatcaaaccattttaattaattactctagtcaaaattacttttaatcaataaacactttttttctttaaagaaaaaatttaattgtattttatattaagttctgggatacaggtgcaggatatgcaggtttgtgctttggtgatttgctgcacctatcaacccatcacctaggtattaagccccacatgcattagctatttatcctgatgctctttctcccccttctccccaacaggccccagtgtgtgttgttcccttccccgtttccatgtgttctcattgttcagctcctacttacatgtgggaacatgcagtgtttggttttccgtgcttgcattagttttctgaggataatggcttccagctccatccatatatatatatgcaaaggacactatctcattcctttttatggctgcatagtattccatggtgcatatgtaccacattttctttatctagcctgtcattgattggcatttggattgattccatgtctttgctattgtgaatagtgctgcaatgaatatatgcatgcatgtgtctttattgtagaattacttatattcctttggttatatacctagtaatgggattgctgggtcaaatggtatttctgtttttaggtctttgaggaatcgccacactgtcttccacaatggttgaactaatttacattcccaccaacagtgtaaaagtgtttctatttctccacagccttaccagcatctattttaacaataaatagctgttgtttcttaactttttaataattgcattctaactggctcgagattgtatctcactgtggtttttatttgcatttctctaatgatcagtgatattgagcttttgttcatatgtttgttggccgtacaaatgtcttcttttgagaagtgtctgttcgtgtcccttgcccaatttttaatggggttgtttgtttttcttcttgtaaaattttttaagttccttgtagaatctggatattagaatcatttcctgagactttgctgatgttgcttgtcagcttaagaagcttttgggctgagaccatggggttttctagatatgggttcatgtaatctgcaaacagagacagtttgacttcctcttctcctatttgaataccttttatttctttctctttgccctggccagaacttccactactatgttgaataggggtggtgagatggggcatccttgccttgggccagtttttaaggggaatgcttccagcttttgcccattcagtatgatattggctgtgggtttgtcataaatgactcttattattttaaggtatgttccatcaatacctagtttattgagagtttttaacatgaagggatgttgaattttattgaaggtcttttctgtgtctattgagataatcatgtggtttctgattttatttctgtttatgtgatgaattacatttattgacttgcatatgttgaaccagccttgcatcagggatgaagctgaattgatcgtggtggataaactttttgatgtgctgctggattcagtttgccagtattttattgaggatttttgcatagatgttcatcagggatattggccttaagtttttttttttgttgttgttgtatctctgccaggttttggtatcaagatgatgctggcctcatagaatgagttagagagaagtccctccttctcaattgtttggaatagtttcagaagaaatggtaccggctcctctttgtacctctggtagaattcagctataaatctgtctggtcctgggctttttttggttggtaggctatttattactgtctcgatttcagaacttgttattggtctattcagggattcaacttattcccggttcaatcttgggatggtgtatgtgtccaacagtttatccttttcttctagattttctagtttatttgcatagaggtgtttatagtattctctgacagttgtttgtatttcagtgggatcagtggtgatatccccattatcattttttattgtgtctatttgattcttttttctttattagtctagctagtggtcttttttttttttttttttcaaaaaaaaatagctcctggattcatggattttttgaagggtttctcatgtctctgtctccttcagttccactgtgatcttggttatttcttgtcttctgctagctttggggtttgtttgctcttggttctctagttcttttagttatgatgttagggtgttgatttaagatctttctagcttttcgatatggtcatttagtgttatatatttccctcttaacactgctttagctaaggaatcaattcaacaagaagagctaactgtcctaaatacatatgcacccaatacaggagcacccagattcataaaaccagttctaagagatctacaaagagacttagactgccacacaataatagtgggaaactttaataccccactgtcaatattaggccattgagacagaaaattaacaaggatattcaggacttgaactcagctctggatcaagtggacctgatagacatctacagagctttccacctaaaaacaacagattatacattcttcttggagccacgtggcacttactttaaaatcaatcacataattagaagtaaaacacttctcagcaaatggaagagaactgaaaacataacaaagagtctctcagaccatggctcaaattttccaaatattttttatccacaattggttgaattcacagatacagaacccatgaatacaggagccagctgtattttcttctccagcattttattatgaacatttggaaacatatagaaaactagaatgaattttatactgaatgcatatagacccagcacctaggttctatagtttacattttactatactggctattatcacatgtttatccctctccccaaccctgtggccatccatcaatccatgctattttagtagacttcaaagtaatttcagaagtcaacccattccctctcacatgtgttgttagatcatgtatatcattagctaaagtttatcactttttacccttctactttgggttacgtttatacgcatgatgtgcacaagttttgagttgcatccatgagttctgacatatagtaaacctttgccccctgcctctgtcaaggtataggacataccatcatcccaggaagttctctcttgccccttctcaggaaccccagctcagcataccccatacaactacttttctgatatcaccatagattagtttgtgcctgttctagaactttatgtgcatgaatcctacaatatgtgcttttggatgtaaggcttcatagcactctgtttttgagattcatccatgtatttgtgtgtaggcacattctggacacatacacatcctcatatacatacatgtagatacacatctatacatattgatgacatatacaccatgacagactttccaggtaaatgttaatttgttgcatgtatttctcttcaggaaatgccttgtagattttagtcatttttcttagatacttacttaggtaaacttttaaagagacttttgtgaaaaatggaaacttagagctttggttgaccacagaaagtaacttaacaagggccagttatccctaatatccctctcacttccttccaaagcagaaccatgaactggtctcaaaaatcttgtgctaggaagggaagggaagaaggaagggaggaggaggtgtccctagtccttgggtcttataaccattcacacctttcaggtgcagcactgcacattcagctatgacagtaagtgggaggagagaagctaagaaggtgggggaatggtctgatttgccgagtaaacagccatgttattctgtagtggaagctgctttcagtggccagcagcctcttcattacagacacagcatcagagagagaaaacaattccttcttcaagtacctttattgggaaatggatgcctggaatagatgtagggatacaaggccccctgcatgaacacgggagttgcatgtgtcagggtctttggaaggaatacgatcgtcattttttccaacaaacgctgtcccagcagaacacttcattggtgtggatcctcatttgtttctttgtgattcttttttatgtgttggttcctgacacacaagttgatttggggtggataacttgagatgcataaatgacatgtacagcagtggcacacccttggtgatcattaatatgttgctctgccatcaagtgccttgctaagttcttgttccccagaagcagattctaagacaaggatgtgggtgtgtatagtttatttaggagttgatcccaggaaacaacagtagaggatggggaagtgagaccaggaaggaaagatgaagctcaaaacaggtcaaaaaagaaagaaaaagaaaaaaaaatagaaggaactgaaaagaaaattctgcctaagttccttctgcaagaaaatagaagctttactcacaaagattccctttgccaggcagatctttttattttgcaaatcaatgaaatagttggtatcattcccagttaccactgtgagcaactcagtttaatctggctggggtcgccaggatacaatgtagaacacatacctcagagttctcccttcaaggggtgagggagctggggtatttatacaccacttccaccagtcatgggttgggggctgttcccagaagtgtcaatgccttggcacgtccagcctgcccctcacacaggaaaagcagtccccatggccgaagacagccttcaggtaaaagactgcaggtgctggcagttggaagttgggccattgtgggtgaggggaaaaaagccggcactgccagtcattgctaagttcccgcatccccccaactacatgatttcaatgttgttgagttggggtggaaagctcatcttgacccagaagaccacataatagttcttccccttcgtgtgtgtgtgtgtgtgtgtatgtgtgtgtgtgtgtgtgtgtgtgttttcatcttgctaagtcccggcactcaacctcagcccattatttttcactgcctcataacatgtgtttgtacaagtgctgactgctggcaagccatcctgccacagcagtgggctcagctgaatgggtgatctgaggaggcatttcagacctaggtctagaatgagaggaaaaacatttcttctttcctcattcatcttttactgcctccgtccatgtgtcagacttctggggactccagtgaagctcaaaacaggtcaaatttttttaaaaaagagagccaataagaaaattttgccaaaactccttgtacaagaaaatagaggctttactcacaagggttcccttcacctggactgatctttttattttgtaatacaaaagtaaaagagttatttctagaagtgttgctggggcctggggcctggaacttatgtaaacgcagagaggagactccatttgagtcctgagtagaagttaggagatatggtatcagcacagaagcacagtctgttctggaggctttgacctgtgtgttattttaggggcatacactggctttcctggcttcagagtcaaaagaaaatggaactatatccacaggcaactggttaatccctcactgggctctaccttgtgtgaaatggaatttgtatttcacacaaaatctttgaaagtgactcaatatgtttaaagccaggaacgctgtggccctggcattcaggtcttccatgatttcttatttccagagcctcccaaatgtggacacatccaactcagtgatgctccttaacccaaagccaggcacaatgagaggtaattcctgctctgggaagtgatgtgtggattcctcaaaggcgatggagtacagtttctaaaggaaaggttgtacctgtggtcttctaaaacatgctcacaagtgctttgatatttctcttacatgaagtgactctgattcccctttccttgaatatggctggcctctgtgagtcccctgtaactgacagattatagcagaagtcatttgccttcagaagctgggtcataaaaacaatacagcttccacccagctctctccctttgaacctggctgccatgttgggaggaagcccaggcatcatggatgaccccagctgaggtcctagctgacaggcagcatcaacaaccagaggtgtgggtgaagacacttcctaggtgaccccatcctcagtcaccacctgactgcaacctcttaagaatttctgagtgagaactacctaactgaggctagtcacacacagaaccaggagacgtaatgacaagaaaagaatgctgctgttttgtgctgccagtgtggtctggtttgttatgcagccacggtgactgatacacacatatgctcattgtcacacggctaaagaacttccggggctcataaaggatctccactgtccatcactcacttccttccttcggtgcgatgactgactggcttcttgactctcaggaaatcagtgtctggggagaagagacaaggaggggtgtctctctctcattcctggagtcttcagcttgctgccaagttttgtgacctagaggcaggcaggaggtttccagctgtttcgccctcaacaggttggagattgagggactgttcactgtctggctgcgagaagtgggggtggcagctgctgcctttcttcctccagatgagatcacagtggtggtggcagctgccgggaacagttctccatgttgtccccacgtgctgtgcctctggccaacatagcacacctaacttgcttttaggttgtgacctccacaccgagcctctgaccttaggaagtagttgcagggtgcatggcaattggagccagtgtcttttccaatgcttcagttccgtggaaggcaggtccctctatgcccaatcacaggcctttcctctcactttctcccctgcacctctccctgttcagcttaggattggatctgctatttcttcatgggctcttggggagaaatgtgaaaatgcatgtgaaaggactttgaaaatatccaaagatgttgcaaaaatggaagctactgttaagggattagtgagcaattagtgggacaggctggagcaggacacctatccagctgtttcagctcctcttaagaccgtaagttagtcataaactctcaacactcagagactttaaaaaagcatgcagcccagaaatcgatagaatgcttggatttcctttgtagcatcaccacagagtgctcttctaccacatccttggttatcctcagtgatggggagctcacttaccacctccttttagaggtcttttattccatgggcaactgggattattaacattgtcttccttgtggcaagccaaactcattttcctttgagttatcttgaattctataaagtaagtcgtatttcttttcctcatggcatacttttgaggtcagctattaagttcttccttgttcaggcttctctctcttcagttttttagtcgcccccttatgtgacatggtttgatgacccccctcagcatctcccttctagttaccttctgggccaaatgcttatctcctcttcagctcttaaaaatcagcctcctgttattatgtttgaacagcttgtgaaaagattggacctcactccgcccatgtttagctgttgaatataattatttcagatgcaaacccagcattcctaaactagcacttaaagccctgcattctctcaagggacaaagtaaaggaaccgggcatttgttgagtgcctccttggagccagggctaggctaagggctctagctacagaatcaccttaattctagtaacatgcccatgagtcaggcattccaggaacacccagaaagggtaggacatacaggagttaaatctcagctacacctaagtgctccttctaaccaccttcctaaactgaacttcagggaagactctcaagctggtggactatatttccataaggagtggtctttgccctacatgtgctaagccctgtgtgggcaggggctggggctgttttgctcactagtagatcgccaagctgtagagagtacttgatactatctataatggtaatggcattaaatcttaggtgaattaatgaacaattgattgaatgaatccatgtaacttctctgtgacaagtttttagtattttatcttgaaacaacaaaaattaatacagaaaactgtaaaggaaaatattacaaactccagtgtatttatttgccaaattaataaatgctaacatttttatatttgcttctaatctttttccatttataagaagtaaaacattgcacatcaagttgacatcctttttatttgccttgtcaggtcttctactccagaagcaaccatcatctttatttggggagtgtctggcctgtgtttaatatttttgcctcatatataagtatgcataagcactaaataattgtatatgttttcaaatttaagcaaatgttgttttactatattaatatttgtgatgttcattccactcatgtatttttgagatctatgtgtatactctacttcatttaactgctgtctagtattccaccttatcacttgattgccatttgcttattcatcccccagtaatcaatatgtgggttgttttcagttccctgttgtgggtagttaatattatcgtcaccctaagttttcaagcaaggaaacttagagtcatcagttaaatgacccatttaaggtgtcagttttaataggttgtggaacgtgataatgaacttagtggcctttgtttttttttttaacttttattttagtttcagtggtgcatgtgtgagtttgttacataagtaaactgcatgtcgtgggggttttgtgtatagattatttcatcacccaggtaataagcatagtacccaataggtagtttttctgattcttcctctcctcccactctccacctcaagtaggccccagtgtctgttgttccttttagtatccgtgtgttctcattgtgtaactctcactcataagtgagaatatgcagtatttggttttctgtccctgtgttagtttgctttggataatggcctccacctccatccatgttgctgcaaaggacatgctctcgttcttttcttacggctgcatggtattccatagtgtatatgtgccacattttctttaaccagtctaccgttgatgggcatttaggttgattccatgtccttgctattgtgaatagtgctgcaatgaacatatgcgtgcctgtatctttatggtagaatgatttatgttcctttgggtgtatacccaataatgggatcgctggatcaaatggtatttctgttaatttctttgaggaatcaccatactactttccaccaatggtctttctcactgtatcagttgtctgccttcaggaaagggagtgaattgaaggaaatgttggactgctttatcttctaaaactccagaaaggaaaatgatcatttttagaggagaccgtaaatgttctatgcaaaaggaagtcacctcgtgtgttccaaggatgagaaaaaactcatgcatgataggaggttatccctgaggctaagtcttgccttcctatctcccatttttgtggtcaccattaggcatgaacagcgttgttgccaagtcaccctactgtgtggctgctgactattcacccatggcttctgagcaatagacaggtcaagtattacaaccaccttgaggttggcccgtgtttcacaaaaaccaggaggccatgggtgaccttatctcctagcttcgaggatccaaaactaacaaatccctggaggatgcagccatttctgtctttggttagcatccttctttaatttcaacggaatataatgtccccgtagagcaagtttaaacaagttaacataaaaagaccgtgatcatatcttccctagcttctctttaatacataggctttgaataacattaatcaagttttacaaatttaccaaaagatgttctaatttctgctacaataaaaaccttattttcccttttctagggatgggatggcatcatggtctttaagccacctggctctgttccttgctattgagaggctcaggggcaatttgcgtaacttctcgtagtttcctcatctttcaaagcagatgttgttgatacctgcctcattgccggaacaaatttaccagaaaacctgagcctgggagtccctacttgcaatggcccttccaagacgttccatctcatttcctattcgttaatttggtaggcttttttaataaagagggtcccctgagttgataagctcctctccctaagccctggctccacctccttgtacattgggttgttgtaaggaagttgcacccctcgctgtgcctgtggcgtcattcatgcccagtaattgttagctgtggttaggttaattttttccccttcttaaaagaacatgaatatgaaaatttctcaactaaaagccaatggtaaaacattttacaagggggaaaaaagcatgcaagaaaatgctgattaccaacaaaagcagagaaaaaattgttcctagaaaagatgaaattgtacaagagaggaaaggagtcatgaaaagtctattcttgagcatcctgaatgcctggcttcttaaataatctacaccctgaaaacttgaacgtgactattttggccctgtctgaactttaagacctgatgagttattttttttctttcctttttgaatgcaaagtaacagttgtgttctaaatttaacttttcctgttggctgcttggactttttgctcacatcaggcccaagtgggatatgagcggctccccatgaaggatcaactctgccatgggctgtcacatccctggggaaaaatggtctcaagggccctgagggatgagtggcttttggatgtgtccattctttctgtgcagtgatattttttccccagagttagtttccttgacatcatgttcctcagcctccccaggagtccccagcattgcctctttcatgaggaaatgtgggaggatggttgcttcctgtgtaattctgaaagccatttatgggatcttcttgcagtttctcacctctttgaatgccttcttagcactcactatgccatggagacccagactatttgtaattgaggcacccgaaccaccaggagggtaagggatttggccaaaggtgcatcacatgctaagagtgaatgctacgccctgacggagggtagaggtggggtgctgcttctgcttggacctccattcttgccttgcttgagtgtttatacttaggatgtttacaccaggtatgacttgtggggttaagaatgatctcatgacacatagaccaatggaacaggatagagaacccagaaataaagccacatctggtcttcaaaaaagtcaacattaacaagcaatggggaaaggactccttacgcgataaacggtgctgggataagtggccagccacatgcagaagaatgaaactagaccccattctttcaccatatacaaaaattaaccaagacctcaaacaataaaaatcctagaagaaaacctaggaaatatcattctgaacattgacgttggcaaagaatttatgactaagtccttaaaagcagtggcaacaaaaacaaaaattgacaagtgagatctaattaaactaaagagcttctgcatagcaaaataaactatcaacagagtaaaaagacaacctacagaatgggagaaaatatttgcaaactatgcatctgacagaagtctaatgtctagaatctataaggaacttaattcaataagcacaaaacaaataacccattaaaaatgggtaaaggacataaacggacatttctcaaaagaagacatacgtgtggccaacaaatatatgaaaaagtgttcaacatcactaatgattagagaaatgcaaatcaaagcaacaagaagatatcatctcacatcagtcagaatggctattaataaaaagacagaaaagaatagatgttggcaaagttgtagagaaaacagaatgcttatatactgtttgtggaaatgtaaattacatcagccactgtagaaagtaatttggagatttctcaaagaacttaatacagaactaccattcaatccagcaatctcattactgggtatatagtcaaaagacataggtactcatatgttcattgcagcactattcacagtagtaaagacatgaaatcaacctaggtgtccatcaatggtggactggataaagaaattgtgatacatatataccatggaatattacacaggcataaaaaagaatgaaattatgttctttgcagcaatatgaatggagctgaaggccatgatcctaagtgaattatcgcaagaacagaaaaccaaatgctacatgttctcacttgtaagtgggagctaaacattgggtacacatggacataaagatgggaacaatagacactgcagactactagagggggaaagtagggagggggtgagggatgaaaaactgcctaatcagttactctattcactacctgggtgacagtatcattcatacaccaaaccttagcaacacacaatttacccatgcaataaacctgcacatgtacccgcagagtctaaaacaaaagattaaaaaacaaaaacaaacaaacaaacaaacaaacaaaaacctctcacgtgacactgcatagcttttctgtcagtagaggtttacgtttcactgacctttcctctgagtgagatctgggtctcccaaggacttgaggtcttctgagccttctgaaggctctggctgttctcttccctggtgaggatattggttggagtggggtcagcattctaggtgaaactgaaacagcaatgaactgggaatctgcagactaaattttggccattgcgttttcattgatcagttggatgaaaacatccatcctctcatctcaaaatggggatatgaactacattactgtgttatcatgaagagtaaatgagataatatttgcaatcatgcctaatatttatagtaccgggtgtgtgatcaatgctcaatcaatggtcacccccctttgaatccttggattttgtatatcaaatgcacagactgactagatgatctttaaggctcctactagcaccaaaatggaatgattttatctgttaagagtgatcttttaaaatctgtctttatgtagatgaaaagcttcatgtagatgagaaaagataaaacgtttttaaaaagtgtctttcatcctcagcaaagtaacacaggaacagaaaaccaaacactgcatgttctcagtcataagtgggagttgaacaatgagaacacatggacacagggagaggaacatcacacaccggggcctgttggggggtgggtggaaaggggagggagaacattaggacaaatacctaatgcatgtggggcttaaaacctagatgatgggttgatgggtgcagcaaaccatcatggcacatgtgcacctaggtaacaaacctgcatgttcagcacgtgtatcccagaacttcaagtaaaataaaaataaaaataaagaaaagttttggcaaccaaaaaaaagtgtcttgtttgtaaagccctttacacaggaatacacatggcagggaaactgaggagtccaccttgggaccaactctgcatctgtggtgacccagcagacatcggtttgcttaagctaactcagcacaggaggatttacattttccttgtgcctcatatttatggaaacaaagaattttttaaagtgaaatgttatctttattaaccatacttgacctcatgtctacatgacacatgacacagaagtcccctccaccagaacacaaagagggcccttagaaaatggatgtgggagagtgaaccaggtaagtctttattcccttcaacctggccattgtttaaattaaggaggtatcatatttatcatattttaattcagggctatgaggttttctaacggactcataaagcaatgctttgaaaggaaaaggtctctagtggtatattgaccaactttgatgtcaccaacttcttgacttttagtttcttcactctacagctgtaaagattgctcaaatggaccttgcaaaaggaaagcttctagctagacagggagtggcttcattctgaaattgcagaagactgaagtgactttcattttgttatgcgttttgtttggagggtgcagaaattaaacctgtgagtctgcctccgcagtcctcaggccaccagctgaggggaggggacatttgtgatgtcttctgaaagctggtgttggagagctgaatcatgccaagtctcccattcatttactgtgaatttgtctgagggcttatcaggatagattctatacttgatgcacttcgcaaacctttattgagcgattttttattaaagtatctgaaatcagtcatgtcatttgcaactcggaatggagaaatactaaacggggttgcaggaggggctttatttcatcgttaaggagcccgtattatgacttaagtacctcatttatctggcatcgttgggatatcgtttctgcctaagtggctgctgctgagggtgcagttccctccacatctaggaactcgacaaatgtctgcagaatgtggttgaatgaactaaatgaaacatctctgcaaacgccaggccattttgaaaagtgataagcatttgattgatatctttctaagtaaatttaatacgttcttgtctgtgagtcacagtgcacggaatgtggattggacattctagtgataaattgaagccatggattcgtggaggacatatgttattttaccgtcttgtaattcagaccagggcctccttttttgttgtcactgtgtccactgtcacttccactacttcctaggtttgtctacctttaaaactttcacaccctcagatcttctaaagtttcatcccgacagcagatctatggttagaacataaactttagtgtcaggcagatcagacttgaaatccagttcctctcattttcttgctgcagaacttgatcagctttcctaacttcactgaatatgggcttcctcatctatcagataaaggatctgtgcttgacctgatgacattaccagttcattaaattagctaatgtatattaagggccaaaccaggtggttagcatgttctcttgccttctgctactcagtgtggtccagggaccagcctggaagtgtcaacacctcttggaagcttgttagaaatgtagaatctcatactccacccaaacctaccagacctatggaatcagaatctgcatattaactagctccccaggtggtacctatgcacactgaattttggaaaacgctggcctagagcttctattttttctcctctttgggagggataacaagatgttaactttagtttgtcaaagcttcagttttctggaaggatgaggggttctaagcatcatgagaagtggccttcaaaaagagagttggaactttttgcaagcttcttctctgtgtggcagcttaatttgagatggccctttattgttcatttcttacccatccacataccaacatagaatcatcatttgggggaatgtgaagacaagggactcctccttgcaccctgggagagctgggcttccagtctgtgctccaagctttcacgccccaggagtgactctgggtcattgggacaggtcagggcggcaaagcatcacactcttcctgctatcagtgtccgaccagcctgagtccccatcctgcacagtgaaaagagtccagcaggcacaatgggcctgagcagagccggacttgacattggaggcagccctgggagatggtgcctggtgtcttcgtggagttcattccatcttctggctacttcacctaggtgtcatgacatctaataactgatttttcattttcttgaaccgatagacccttgctttcacattaccccttctaacatgtttctgccacattctaaacccttgctactcagagtgtggcctcaggcccagaggcatcagcaagactgagagcttattggccacacagaagctcagcccccaccaggaaaatgcactgagtctgaccatgaatttcaaaagttcccaggtggtcatgtgcacagaagacttggacaagtgctgagctagtgtatgttcagtaaatattaattttctcttccatttttaaacctggtgtatgaaataaaaatcaataaggctctgaatgagagcttgagaaatgagaagctcaatatcagggcaggaattccatgaggactgtctattctctggtccaggccagttctctggaaggtccgggttgcttcaggactgacctgcggctacctgggaaggaaacttactgctccagccactgttcttcctcatagatgtctgcagcctatgaagccttgctgagacagtcattatctgtgctgcagtcattcagggcagcaagcatataaacagagcttgatgctgccttcagcttccagttacataacctcactttggagtcatactttccagatgttgtgtatggacatgctcccttcttgcactacctgtttctttagccacattcaacttttgggggaaaggtctaaagacaagctccaaggacagccagcatgctttaaatctgaaataaagccttttttgagcttataatcatgtttatttgctttgctggagtctttctgaaagcttttcatttcttttttattccccctctatgtaatcttccttcgttcctttcttccttccttgcttccatccctccttccctttccttccctttccttccttccttcttgccttcccttccttttttccttccttgccttcccttcattttttccttcctttcttcctttagtggagaagcacagtttggggtcactggagcttgggttttggttactcatatgtgtgtagagacttgagttcagatttgcgaggaatttgggcatgaacctaaacctcatgttcaaaggctcaaggcttcaagagaaccccaggcttgcagtcagcaacttttggccagcagggcccgcggatgggttctctgtatgtggtggatcattccagggccccacacaggaaatcaggatgaggtcactcaacagccccatgctccttcagctttcatgctggtccaggcattctgctaatggtgggaaggtttggagaaagaagagatacagtcccagccctcagggatcacatgcggaaggtagtggggagaggaatccagctacatccactcagagtgatcaatgctgtactacaggtgtgcacgttggcccccacagagggccaggatggggcctcccatcctgggaggtgtggggtaaaggaaggcttccaggaggaggcagtgtttgagtcaacaagtgtccccaaaggaaaacagttagatcagatttcaccagggaggatgatggtactcatttgaggaggtggaagccatgaagtcaagatagcctgttagtaacaacagtatgcagctctcttttttcccctatggccagcagggaattcatctgccacacttactttccacactcattaaatacatcttcccaaagggtggcctggaggaaatagggatgcagtctcctgatgggatcgaggcccactgagaaacatggctgccggtgctgtgtgtgtagcatgagggtttccttcccatgcgcccttcctctttcctctgttgtgggtcatgaataactatgaatccattcgctgctcttgttctacttcatgtttcaaacacaggaaatgagcctctaatataagaacaataaactcagaggtagatcactgcccggatggaaaattgccatgtgaaccaaaatgacacttgattagtttgttaaggtgaaaacatttttctaagtggcagtgggtgtccctcagtgagatcccagcattggaagagttcttcaggggtgtaagacacaaagttccattttcccttcagtgaagggcttcattcttgcatgtagggaaagtataggtgtgccagacttcatcggtgggtagcccaaggcgcaggggacagtgttccagggaactggtcaaagctctaggaatttggaagttagaacagtataggtatatatagcttttatatttatatagttgattttttaaaacttgaagaatcatttaagaatgcatacatatcctagagaacccaaacagtactgaactatacagggtaaaaagttaaaatcattctccacttacctcctccagccactctgcacaagggtaactgaccattgtgaacaaggaggcccagaaggtgggattcttcatgatctcttcctattcattcacaagtatatatataggttattaatacaccagtgagatacactttacactttattttgggacttgctaaactgctgccttgatgttttattgttttgttttgttgccctcacaccttttgtctggactttatgttgacaagtgtgatggagaagggccttggggttgtgagttttatcccaggacttaaatggaaccagagagttcccatgtgcttctgaggttgctcaaagctcagagttccattggcctggtgtgttttatgtggtggcagcctgggtattggtagcaatggtgatgctggcacagcctggccacttgggtttccctggccattgtattgtaaagttcccatttactttgtagcagtgtcaggaccaacaagatgagggaaaacagaaatgttctccagggttttcaagtattcttccttttctcttgcttttttttttttttttttttttttttgacatggagtcttgttctgtcacccaggcttgagtgcaatggcaggatctcagctcactgcaaactctgcttcccaggttcaagcgattcttccccctcagactcccgagtagctgggattataggcacccgccagcatgcctggctaattttgtatttttatggagacagcatttcaccatgttggccaggctggtcttgaactcttgacctcaggtgatccgcctgcctcagcctcccaaagtgctgggattacaggcatgagccaccacacacagcctctcttgtttttttatgacctcttctttctggccaagggagacgaaatgaagcatgttgtttcggagctgctcctccacccagagatggaattaaatcagagccttccaaggaaaagcagtggggtgtctggttcctcccctgtttgctctgggctctgtacttgagtggcactgagaagggccagggaacctgagctaggctggaacccagcctgttctgggtcagtggcccatttcagctctgaggtctgaacttgcctctcctgccactgctaggtctttcttttcttagttgacttaacaagtcagattttgagatttaactaagaatccgaggcattaaacctagctcagctacagtaatctggctgctgattccatgtggacatgtaacagctcctgctttcagagcaggtcctggggatcacggtgatatggggcaagtttctcttgtgcttgaaccttttcttctgcccttttcaaactagtaacagggaggtaccatactgacaagtttaatccctctggggctttagaaacttgttttgctgctccacttcaaccccatgaggagatgatacatcttaaaggatgggcagagggagagggcgatgccagatacatgagttgaactatagaacttcaggtcttgaggtaaggaaaggaaaattcatgctgtaagcatcccctgatgaaattcacagaccggtcactgtggtcatttatccagctcatgtttacagaacccaggactgttgataaacaacaaaagccttcacctttgaaaattttctgtccccaactttgtctgtggttttgctgtaaggtcccaggcctgcagacaggtgttcttccaagggccaatatttttttaggaaggttggagtaaagatgcactgatacctagttctattccaaatcctctttttttgtttttatttatttattttattttattttattttattttattttattttattttattttatttttgagacagggtctcagtccaccacccaggctggagtgcagtggcgcaatctcggctcactgcaaccttgacttcccctggctcaagtgatcctcccacctcagcctcctgagtagctggggctacaggcatgcaccaccatacctggctaatttttgtattttttatagagatggggtttcaccatgttacctaggctgttctcatactctcgggctctagcaatctgcccacctcagcctcccaaagttctgggattacaggcgtgagctactgcgccctgcctttaaatcttctttactggaattgtagacacttaagcattctcattccttgtctgcaggatgaagggagttgctgcggaagcttctctgccatcaggcagcctgtaactcctgccatgccagcacgcttcccatccgtactcacagtcttccggaaggaatgtcagcaaagcttgtcataacacaccttagtggttaccaggccttggcctgtcggtgtgtctggacatgagttaccgactgtgggcaggaagtctgacgtttcagatgtgtgatttacacatggtgtctgcaatgcacagaattgcagtatcaccctgtcatctgacatcattaactgcatgttgtggcatttggtcaaaggccacacataaaagtgctgaagaagaaatttgctttgattttctaggtggtagggccagtgtgctggcaatcaggtcacttgcttctgaggcacccgcgttctgtcccatctgctctgtttctgctatttttgcaaagaaagggtccttggcattactgtgctcagattcgcctatccttgcacccacacctgtctctatagttcacacagggtaggttggtttcctctgtgctgggcagacctgatttccctcttctccatcaaactaggcatgttttaaatgggaaatggaaaggaggctgcggcagcagcctggcagtggccccagggtaggttttccagaatatgatgctgttaggacgagatcactggggctggggtgccagagaccccattcaggtgcaaagaagcaagtgtatggttgagggattttctatccagcaccaaataggaatggaatggagtgttctggaaagaggcaagatttgtgctgaaatcctggggtcatggtcttagaaagtcttagaaagctaagtgggttatatggctgggggcagatccctgaacctccctgggctatggattctttctacaaagtgctgatgtccctccctcctggttgtggtcatagaaattacatggaagcgtgcactgctgtgctcaggtcatgatcaagaacacaggtgctggtgactttcatgatctgttgatgtggatccagtggctcttctggtaggagggtcatcaccctgctggaagattacagcactgtaaccagagttcacagttcttttgttcactcgtgtacataaacgtaggtgctcctcaatttaaaatgggattatgtgccagtaagcctgtccacaactgaaaatatcataagttgaaaatgcatttaatacatctaacctagcaagcatcgtcacttagcctagcctaccttagacatgctcagaacacttacattagcttacagttagccagaatcatctaacacaaagctttttattacaaagtgttgaacgtctcatagatctgttgagtacaatgtactgcagaatgcactggtaatagcatggctgggggcggcagctcaccgcagctgcccagcatcaccaaagcctattgaaccacatattgctagctcaggaaaagatcaaaatttaaaatctgaagtacactttctactgaatgtgcatcactttctaccgtcacaaagtggagaaatcccaagatgaaccatcaaaaatctgggaccacctgtactaaggaagctctagttaagtgggggtttgagcaaagacaaggctgcacagttcctacctcttggtgcttctgtagagctggagtgagaagggtgaaataaaggcttaccagggtttacataaaaggccaaggaaggcagcgtgtcctgcagccactgggtcagggtgtaggctgaaaaccatcagggtttgctccacctccgggggagcaagtacgatggtccctttgacaggacagggtttccctgtttaatctgagctatggctcataaatcagtcaaataaaaaaatccaatcttgaaaatgtctagcattttcaaaaattctgggattcagtgaagacaatgggagccataaatcagccagacaccaagtcgtgccgactccccctgggcaggagcacagagtccaggccaggttggccctaggggctggggagaggtcacctgacctgaaatggactttgctgaggagacaatgagaatgatctcaaggtctttgctgaggaggcagacttctttaagtgttcccaattaactctctttgcaaaatttttaaaaatagaatctcttgatttctttttttaaaaatttcctacttttattttaagttcaggggtacatgtgcaggatgtgcaggtttgtgacataggtaaatgtgtgccattgtggtttgctgcaaagatcatcccatcacccaagtattaagcccaacatccattagctattcttcctggcgctctccctcctcccacccctctgacaaaaggccatacacctacaaccatctgacctttgacaaacctgacaaaaacaagcaatggggaaaggattccctatttaataaatggtgctgagagaactggctagctgtatacagaaaattaaaaactggactccttccttacaccatgtacaaaaatcaattccagatggattaaaaacttaaatgcaaaacccaaaactataaaaaccctagaagaaaacccaggcagtaccatttaggacataggcatgggcaaagatttcatgacaaaaatgccaaaagcaattgcaaggaaagcaaaaattgagtctccttgatttctaagtgagctaccggtgactgggcagacacatgcattcgaggtcttagaatcatctcatttctgtttctcctcaattgccaagtgttactttcatttccactctgctctgcaagatgactcccctgtgacctgctgcattcacagaaaagaggcaaaaggaaaaagatcacttcaggacaaagcagccacagccaggcccatgggccatgccttctcaggccacccctcactcctgtgaccccaaagggtaaaacagcttcccatcccccgccccaggacacctgtttagaaagcttatgaggaagatctgttcctcctttgagttgctgtagacaggtacactcatctttggggagggttctcttttgttctccccttcaccagctcaccccttcttgccagggaaatagaattgcttgtctgggtggataagcatgccttgtgtttacaggacacctctctcctgaggagtgtaagccttttacataaaggtgccctcgggcatcacagctggtatagtaatagctgcattctctgggtctttcaggaagcagacaccactgtgcctgcccatggttccttgctcttaccacattggtgcacactggccacattctgcctgctcacacctgcattcctttgcccaaaggctttctttggaggccagagtccacactgctttgtgcatggcaggctggaaatgtcagagaattaacgacctctggagcagccctcaaccaatggctgatgggaggtggtgtacaaataccccagctccctcatccctacagggggctgactctgaggcacgagtctgcactgtctcctagagttgcccagtaggattatgctccacttgcccacagccataacctgctggataacacaagctttatgggcagcctttccccctctctctattccttcttcctctatcttcacctcccaaatacattactctcagtgtctgttcagtgggattgaaagccaagacatttacttgcatccttttgtaggtgggcgatggtagacctagggaagaagtaattagccatgatgaggaggctgagagacaagacccaagaaagaccagagccagggggaaacactggcatctctgcctggggaggctgtgctacctcctcatccctagtactgatgttcacgactcttccagaaaagccgagttagctctcctcatgctgatttcctgagacttagctgctcttattaccagatatgaaatcaagagtgggagacaccacatgtactcctttgccacaaagaggcccccttgcaatctccagtcctagtctcttgcttgtcccacaggtagaagggtaggtgtggggagggaatactgctgtgcacctgagacacttagttttagtgggaaaagacagcacaaggacacgtgggatgctcttcagggctggaagagaggctgatgggggtggggcagtcatgtccccagaactgctgtcctgtcacttgcagggttacagcctgcctgcgaggggagataaatattctgtcttgttccatgctgaatggctgcctcggtctaaatgatgcttttttttctccttttgagatagcatctttacttccacacagttcttccccttgttaccagcattttccagacctcagaagaaagttcgagaaggatcctggtcttggtgatgtgagagctcctttgtgccatgttttagagcctctgcttctttttgcctgccagtgagttcactgcactgctgttctttgcctcttcctgctctaaactttacaattggtttgccagggtgaggctctgtttcctttagggaagtagaaatagaagatcaaagtgaatctaaaggaaccatggactctactgtcccatgagcaggacactggtaggggctggctgggcttaatttttgctccgtaaatatgcatgtgtgtttattacttaaaaagtgtatctcaagtaagcattttccagcagaactgccttatacataaatcagtgcctcagacctattgcgattcataggctctgcacctgaaactcagatgtggctcaaatgcagtggtgtgatacctaccacagcaactcgccgctgctcactcttcctcactcacagtcagccctgcctcatggcaagctcctcttgggtccttggtggatgcattgaactgatacttctgcgggtgtggcttcaagacatgctagagatgcagaaattaataaaatagactccttgccctggaagcaccagagtctaggaggcagagtgctgtttaaaatactcaacagtgacagagtacctggccctaggttggatgcagtgagattttagctcttggagttaatgggccatgggggaggcggtgttgaggggtcctggtggaggaggcagcaggaaagcacaggagtgggcactggaggcatttggagggcagttatttaccagctggtacagagcatcttggtattttaacagctggtacacctgtacatgtgtaccccagctggcctgtgcccatttgaccatggggtcatgggacgcatacctaaggaatcagtgcactgggtttgtcaaagggtggtggctccctgccaagcatggggaggtcgcagagcttcctcctaaaactcctagggcagctcttctagacctgctctacttctcagcagctgcagcatggatggggaaagctggatccatacagcttgctcacctctaattacgtttgcttgaatctgttggcaggtcaaggctgtgcctggagcccagtgtgtttaaataaaagctgagctgaagacgcgccaatgtcccttgtcctgctctgtagctgttttgtggctttgttttctgtcgggcgccgacggtccaggctttgtcatttggagaagtggtgtgcatgtgtttttgtttcactcaaaagatggtaatttcctaacatcataaaggtcgagttatgaaattaacatgaggggatgcctgagtggaacttaaaagattatttccacctcatttaagagattgatgctgaattgctattctggagctcttgggtttgggcatctgctcatttttctgggacagatgttgtccctagctttgttcatgggatggtcattctgcttggagtgtgctgacctcatggacacagttcatgtctggctttatgtccacatcctatgcaggggctttatcacatctgcttggtctctctctctctgttatgcattatggacacacacatgcatgttacattacgttacacatattttattactattcagttgtcgctcggtatcttcaggggatttgttccaggacccctcacagttgccaaaatccgagggtgggtgcccaaatccctgatatgatcctcccatatgctttaagtcatctccagattaattgtaatacctattgcaatgtaaatgctatgtaagtagttgttttactgtattgtttagggaataattacgagaaaacagtctgtacatgttcagtacagatgcaatttttaagatattttcaatctgaagttggttgactctgtggatgtggaattcatgaatgtagaagactgactgtatacagaatgtgtgtacatgtacacacacatatatatgtattgaatatgtggatatatatgtatacatacatacatatgcatgtattgtgtctatatgcagttagtcctctgtatccacggtgaatttggaatccacagatatagagggctcactgtgtgtgtgtatatatatatgtatttatatatataatttacttttttgtgtgaaagcgtttgacagtaagctgcagaaagacatcatgactctttggctctaaatacttcagcctgatctagaaacaaagccattatattcctgctcataaccacagtgtcattatcacactcaagacattggagcagtaaccttaagaagtttaaaaacaatacaagtaaggtttttgtcacattaagcacttgagtgatggagcgaacacagcgattactcattatggactaagcgtttcccaagtccctggcatgggctgagcactgcacttagcactaaggaggcaacaggcagaggaaaaacatgaatcggtgaagacagtgaaaacatgtgaaggaaaggaaaggaaacttagagaagctcatgctacgtaacttcaatcttggaaaatcttagaacattaaaagccacttctatctctagactgttagatcatccagaaatcaatacaaatcatcttaagattatcttatgtcttaggtctctaagacacttgttacatttaaatgggcttaaaataattaaaaccatatgttaagggagagtggatagaagatgctgtaaagttttgtatagttaccttccaagacgttgaataaatacagttccattttctggtcaaattaatgtcaataatgtctaatatattcctatattcttatttctccaaatcatctccaaaagtcttctatagttttattttttaaatctagaatctagccaaggttcccacattgcattttagaaaatctcctgccattttctttttcttccagccactgacatttggatgcatccaggcctgttgacttgcagaatgccccatgctctgaacttgtctgattaacggattacctctctctgattagatgcaggatgaacatctttgacatcaggggtgcggtgcccttcccagtgcatcacttcaggagccacacgatgtcaatatctctcatatttgttaactctgactgcttggttatgaagtgtccaccaggttgatgctttgtctatgtaaggtgctcctgcttctcaacaacctttccctctgtggctttagtatccttggatcatcctctcctagatctttattatagcagggtgtgcaaaatggtgattttcctattcaatcatttcttctacgttagctggtattcctctctaaatatacccctccccttttagtatcattatggattcatggattgagccttctttccttccttccttcccttccttccttccttccttccttccttccttccttccttccttccttccttccttctttccttacatccgtttttaatccattaccttcattgttctttttggttttcaaattgtcccaattttggacataagagcccatttaagctgacatggtcctaacagaatttccaaactcacctttttctttcctgtgtgggtatttttgactttcaaaggcttgggatttccctctagcctgcatctacttgttctgtgaaatttagttaggttataacagtctatcttgtaattatcgagcactggtcttaaacacatagtgctccctcatgttcactctgcacacacaggagatgcaatttgcacaccagaccttggctcacagccacaagctcctggaatgcagcaaacccagggcctgtggttaagcccttctctgagcttgtaaggatgaactcttcttatcagctggagctggcaaaaagacggtagacataaagacagtggggctggaaggaacccattttggatgaagaaattttcctttaagaagaaatataggccgggcgcggtggctcacgcctgtaattccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggaggttgcagtgagccgagatcgcgccactgcactccagcctgggcgacagagcgagactccgtctcaaaaaaaaaaaaaaaaaaaaagaagaagaaatataaccttctttattcttcaagctattagagcattgagaatagagctttgtaattataagcagaatgacctggagcaaaatttatgcatggactagcggaggttagagtgtgagcaggtccatgccacataagcttttggatgacccagcctgaaaatgttccagatttatcctaggacacacaggtttcaactatagtgggtgtttctggcaaggttgatcatttcttttatatttaagatattttaaaatataagggtacctcaagaaccaatggaataaggccttgtggagcaaacaggactagaccttcatatccagacagctgtccccccagcacacatccctagcctgctgcagggaagtcctcactgtcagttttccccctgtgaaccccacatccagtgggttcaccaggcagttaatatgggaggccaagacctaagggggactttagctactatttatacattttatggaaccttctatcagagaagtgctggaagccacactgacccatgaggaaaagtgaaagctggaacttcatttgctgagatggcagaagaataagctttagctggaaaattgttcctttccattactcagtttaaaaaagtttttttgatagctctgcaaaccatttaattgatgttattatcatcagcagcatcattagcatttcaaaaaagtctgctaaattaagaatatttgctttctagtctgtcatagataagaagaatacctgccttgcaaggtcgttgattggtacatgagatcacacacagggagctctcatcacagtgcccggcgcaggatgagagcccagaaaacgctgctggtgatgactgaacaagcttggttgctgccatgatgtggcctaggaacacttccaaatgaaaaatgctcttcccaagccattaaataattcttcctgtttcagtcatgtgaaatctcctggctgttcactgtggcggatgagaagtcacaagtggatgttggggggcaagtttgactgtcccttcccctcattagagaagggaaaattagccagaatcctgccttccttggtgctaaaacttcactggattggtttgcaaccatttttgatttgaatatttttaactgcagtgagattgggttacacagatactatcgtgtctaaattatacatcctgtggcatttatcacaagacattttcactgctctaacagatgagtgggaagttctgcttttaagaacgtatctttctcaggttggcactaagtggtgtcacagtcccatgtcccccagggttgtcctggccttggggttcactgtgctctttggcctcagccacgcttctcactgcttcttctgactttgcgccatgagggtttgacatttttacccatccgtataatcaaaggcaatcaagttgttgcttcattaatgacgtttccttaggctatgtctatagaataccaattatatggctggaaattgggctaagtcaattatcttatttttcccaaagagtttaacacaatctgagatttggattaatattgtgacacatgccgtcctgagaaatgtctcagacttttgttcaacgagttaatcctcctgctatcttcacttttcttttctttttttctctcaaattttattacaaaatattcactaacaatacaaaaatccaatgtcttcacttttcaatcgttaccctggcagttgacattcaagaaccacagctctgctgttatgacagcttggaaggtgaatggacggtagatggtagagcctttttttttttttttaatgacactatctcattcttactcatgtttgtcattctcttgcactcctaaaataccttaggtagcttttcggtcagtggggtcacctccttaggagagagaaggaacccaggctggctacagtggctcacgcctataaccccaatactttgggaggctgagacaaggggatcacttgaggccagaagttccagcctgggaaacatggtgagaccttgtctgcactacaaaataataataataataataatattaataataattacctgggtatggtggtgcatccctgtagtcccagctactggtggggctgaggcaggaggatcccttgagcccaggagttcaaggctgcaatgtgctgtaatggcatcactgcactccagcctgggtgacgaccgtgagaccctgcctcaaaaaaataaacaaaccaacaagaaagggaatccagaccacagccttgggtgctgcattggatgaatagtccctcctgttctcagaagcgatggtggtttcttccagtgccctgctccttcctgaccaccttcatgggagaggaggcagctaccagggccctaggatgtccaggttgagtgttccttgtctgaagtacttcagaccagaagtatttgggatttggagatttttttgtttttttgtttttggattttggaatatttgcaaatatgcatatatatatatgtgtgtgtgtgtgtgtgtgtatacatacatacatatatatatacatatatatatatatatatagagagagagagagagagagagagagagagagagagagagagagggagacatctggaggagggggacccaaatctaaacatgaaatttatttatgtttcatatacactttatacacatagtctgagggtaattttatacaatattttaaagaactttatacacgaaacaacgttttgactgcaaccagtcacatgaggtcaggtgtggtattttccactggtgcttcatgttggtgcttataaagttttggattctagagcattttgggtattgtattttaggattagggatgttgaacctgtatttctctctgagtgtgttgttctgcctggcacgtgaattcttcctttggcatccagggcctgtaagcaacagatggggtatgcaaagggggtagtgcttcatgaagggcccccattaccgagatgtgggcaggacaagggagccaagagcagatggtgaagcacccagaggaccaacagtgaggggccatcatcatcctctgcccaagggagcaaaggaggacagggacgagctgtggatgctggggacttgatggggactatgggctgggagagaactacgagaataacaatcctgactactctcttctttcactctttaacttcctgccattggccaaatccacctggaagccagaggggaaaggagccaggtccggcctcctggggcacaaactaggggcagtgggtgtgtagagctggatcagggtaaaaaggagaatttctagcacattcagttttttctttcttttcttttctttttttttttttttcttgagatagtgtctcccttggtctcccaggctggtgtgtagtgatgcaatcataactcactgcagcctcgaccttccaggctcaagagattctcctgcttcagtctccagagtagctgggactatagacacatgccaccacaccagctaatgtttgtacttttattttttgtagcgacaaggtctcactgtgttgcctaggcttccctcaagctcctggcctcaagtgatcctcctgcctcagcctcctaaagtatgttgtcctttttaaaatacagaacaaagcttgtttcctttgttttacagaaatagattatttggaaatccaggaaaagtagatcctgccaataattaggtcctgtttagaaactcattagcagaagactttgctctgggaaagagttgcggccttcccattttatgaaggtttactgttctctacatttaatttaacttttttatttctttaatttaaaaaaacgtactaatatttagctaccaagtattggatcattttatcctgttctgtttcaaacacctggaaggtaatttctaaagctcttttctctggtgattactggagaggtagattactggaaatgcgttgagcttgtccagctattgagaaggtcactgttgactcccgtgtgtcctcactccatggcggggcagggagagtgacggagcagcaggcagccacaactgctttgttcccaaatgtcaaggcattgggttgtcaataaaaaaacgttctttcattttcccatgcaaagtgccctcaggtagagatgccaacggatggaacatatgagcaacaaatgatttgttaacttcacagactcttgccagaataaacaagagaagtggcagtgagtgctctacccagagccccctctggaatctcagcatgagacttcacacattacaacccttctgacaagggttgtacaaggtctccacatctttgcctcaagtggagctggctccaggacatgtggttctgctctgatgactgtctgttccatttgcatgtggtctttgtcgtcatatcattgttagatgttactgacgtgagcttgtctgctcccagcctcaggacgcctgtggctttcttggtttcccctactttcatggtctgatgcatgggtgcatccttcttgttttgtctccatttccacaagattatgtagaagcgcgttcattcattcaatgtatatttattggacacccactgtgtgtcactcattatgtgttctggaacataaggacaaggaacaaagaaggaaaagtccttccatgcatggagtttccattggggtggtgggggctggtggtgaagacaaacaaaaacatgcacaaataaatgtaaagtatgctcgaaagtgatacagaaaaaaaatgaacaaggtgagagggatgacaagttggggggagtttggagggcttgctttttaaggccaaggttgaggtgacatttgagcagtctctgaaggagggagggagggagccatggagagttctgaggaagagcatccaggcagaggggcagcaaaggccagggatggaagcacgcttggtgtgtccagagaatggcacagagggtcagtgtggctggagcagaatgagggaggaggagaggagttggagggacgtcaaaggtcgtggggaaccaggtctcttagggtcttgggggctggtggaggtcttctgcattcactgtggagtggagagccgcctcttgcttcctgtgaccaggcatacattgttaaaggatcaaccagaatgttggattgataataaaatgtagtgggcaagagtggaaggtgaaagactccagagagtattataataatggtggctcagttcagagcagtaacaggggcagggtgaggcggtatctgattccggacatggtttgccttcttgcaggattgactggacatggtttgaattggtgacaacaccctgaaggagtggatgtgggtgagaaagagcaatagaagactctgcaattcctggcctgagcagttgtaggagaaggtgaggggcgggtggagtgagcttcatgggagaccgggtgtcctgtgttggaagtgctcattttgagatgtgtcctgggtgtcccagttgagatcatgagtaggatgataataagagtgtgtgcatctggagttcaggctgcaggtcaaggctggagataccaaggggggactgggaggaagacagaagcttatattgacagccatgaagtggaggggattccccacaggagcaagcgtaagcagagagaggactaagagcccagcccaggctctgcgaggagccagcagaggaggctcggaggagcagccatcgaggcgggaggaggatcaggagaggtggcctgaaagttgggcaccagggaggcgggagtgagcagtgggttgcaggctgtggatgcatcaggcgactccaaggccattagtgacatggacaggaagagttgtggtgctggtaggaacaaaattctgattgtaatgggtccaaaagaggatggaaggggaaggattggaagcaaagcagattgataactctttttagttttgctacagaaaggtgaagtagtatagtagttcatagggaaaatgggaataagattttttttttactggttagaaataaaacgaaagtataataataaaaaaagaaaaaagcttgtttttatgctaatgaaatggtttcctgtttacctgaatgtattggctttacagagtcttttttctattcatattaactgatctgaatccatttcttgcactccttcattacatgagcataccttccctcctatcagtagagccggtcattattcctataggaaacacaacgagatgctctcaagtccagtttagttcagctattccttgggcacttataaatcatttcatatgctcaagaaagaagtttgtcacattactttggtcattataatgtttgattgttttattctatcatgaagctatgaaggctattttgtatgcagtattattgaatttgttgcctagtttgcagggcagtgagatatattgtggatttattcttctgggaacagataagatccctccttctgaatcttctgccccagaaatatttttcccccttcatagctaagtgactcaggtgagttagtttgtggttgaaaacatgttccttgattccaagtttgctgtttgcttcatctcatctacttaatacacagtgagtgctagccttttacctgtgctatttgaaggtcaaggctttgaccttggcagcatgtggggaccctctgtgagctgatgtatgtgaaattttgcttgttccaggttggaggcctgccatgttactggacacccctcgagctggttggaattagttttaatcatctgcagtctctacacatgattttaactcagaagggctccttaacacacatcacagaccattttacaccatgtttattgcagcaagagtctggggctaaccagatgacacactcgtcttctgaaacaaaatcgtgccttaggacggaaccatcttagttgcttgcagggatgcggtgctgttgtctcctggccagaggtttccctgggcagggctgggctgaggagggcctccaatcggtgggtctggacctgctcagactcctcagggctggtttctctttgtcccagaggaggtggtcagggacagtgaagagctgtggctgagccaattaaatggcccccagctgtccagggccctgatgtgggagaaacgcttatttccccattaaaggggaaaaagggcatctttgaagcaaccaggattttatgaatgtacttaaaaattatcctcttttatacagaagccatcttgaaagggctctcactggccaaatatggtatatttcaggagaggagataaaatataaatcttgggaaataagaatccatgatttcatacttataataaatagataaagcagtggagaagcaaatgtggaaggaggagggctcttgctttcagtagaacactgactattaactgctaaatgtggagaaggtgctgagttggaaactcataattttgtaactatcacagtaaagattggtctgataaaagtcatcagtagatgcaaaatccatgggaaagttttgatgaggatatttgcatggtcttcaaatgcctctcataagtgtacagtgggtaaatatgacagcaccttgactgaaacttccttgttaaagttaacatcaccaaggagaccgatggtcatggtgccctccacatgtgatacaccttcctttctgcagtattctggcaaggaaggcatgacttgaatctagttatgaggaagcaccagaaaaacccccaatgaggaacattctattgaagcaagggactgtgttcttccaaaatgctgaagttgtgaaagacaggaaggctgaggaatagctccacattagaggagaccagggaggtgggacagctaattaaccacacctgaatcagatcctgtactggagggagaagtgctttagtgcatattatcgggtcaattgacagtttgaaaatggacagaagtttagataaaagagttgtatcagtgataaacttactggaattgatgagtgtgctgtggtcatgttagggaattcctttattcctgggaaataagcattgaagtatttaagggtgaggggcaatgatgcttgctacctactctagaacagttcaggaaaaatggtatagatagatggatggatgagtggtggacagataggtaggtaggtaggtagatagagtagatatgattgatagatggatagataggatagttggatgaatgcatagatagatgatagagagagataatagatagagatagaaatgatatagatagataaacagaatgctaacaaaaatgagtacaatattgacaataggtgaatcagggtaaagtgtttatgggagttccttgtacgattgttgtaatttttctacaagtttgaaattacttccctgcaaaaaatagaataaataaatcaggccccctttttattgactgattgatgccttctttcaggattgattgggcattggtccatctcaggccccatctttcatgctgtgagccacacagacaagctcctgattctcatgaagcttccattctagggggaggtgtcagaattaaggaataaacaaagaacaattagaaagcatctgattttgatcagtgttacggaaaaagggaatgaggaataggtcgtgatgggggtcgatgggaggcgtcctttggatcaggagccatgggaaaaggaatttgattgagggaaggagtcattcctataaccagccaaggaagaacattccaggcagagggaccagccgctgcaaaggcacccaagccggagggagacggaggtgcttgaggaacacagaaggacattgcagctggggattagggagagaaggagaagaattggagcgtcttgcagggctggaccatctaaggtcttgtctgccatggtaaggagtttagattttattctaagtagcagagggagtccatggaaggttggaagaatgaagtgacattaatgaattcatgtctccatatatcactctgattattgtgtggagcttgaattgtagtgggacactgagcaggaacagaagccagtgggccaccgctgtggcctctctggggacacagccaccccctcaacagggagcaaggcagctccctgagcccccttgccttgtttcccctcgccagccctcaccctcatggggttgatgtctttaggagtatagcatgattccggcacaccatctttttttatttcttttatatcaacacatgtctttagtgaagtcactcaatgcctttcagcaactctaaaaatttaccaggtttctttttccaacattactttgacacatgccaagaatgacaaaaatgcatctctcttcaactgacttctttctgctgttgagctgccttcagtcttgagcactggggaagaataaatagaaacccagaatgggactgaggagacccagttccacagggagaaaaccaccttgaggtttcagaagggtatttgggggttcccagcgctccctaaaataggagaggtggcaagaggaccttggtcccatgaacactccagcactacatgggatactctgaggacacagaggctgtggcttttcttgcctgttggtgggttctcttctctgcctctatcctgtgctaccagccaccctcattgagaatttggaattcttaagtctagggagccaggacaatttagggaggatgctctaaatagctttctggttttgtctcctcccagggtcagatgaactgaggtttttctttagcaggctaaaggggctgtgtctgggttcttgtggctaatagagggctgttttgttgtgggatcatcctgccagaaactgggagggccagggaagtgtccttcaaagctgtgagtgattctttaaagaggggcagtggttgtaaacccttcacacttcaagccatgtggctgtctgtctgtttatctgtcatctgtctgaggagtgaggggatgtgtagtgggacagtgggtgtccctggaaagaaatttatccctgacatcagtagttgtggtcagacattcagttggttatgaagagtggtacccttttatcttcccccctggacttaatatttatctgccctaatgcatctgttcattacaaccagggtgctcaaactaggggctgagaaacagattctggtgggagcttcagtggccccagcagatgcaggagtcttagggggaagtgacagatttggcctgttgcaaagagcggtgtgggaagagaagggaattgtttcaccaaagcggtttgtggtatcagtaataatcagagaactagggagaaacgaaattttttaaaagaatacatttttgtgtgggaatttgtatttcgttgagcaaacaatatgttactggtgagtccagtcttgctagtgtgtgtgtgtgtgtgtgagtgtgtgtgtgtgtgagagtgtgtgtgtgtgtgtgcagtataactgattattttactgccctggggattaggtgagttgatgactgaacacggtaattctgaaaaatggaggggaaggagcgacattagtataacgattgcatattctgttgcctagcctcagtgccagtaaattgtcctccaccacacatgacttggtctttgatttttgaatgtagccataaggttcttaagctggaataatgtgtgaggtcaaactgcctgtttccatttatggtgaaagaagacaagaaaagacatggttgtgcatcctgtgagtatactaaaaaagggtggaattgtacattttcaatggttaaaatgtatgacaggtgcattatatcagaagaaaagctgttaaaaaaaaaaaaagacagcaaagagaaatagacaagtgtgactatgaagaaatcaaattgtaaaagtcacacaggaaacaaaacatgtaaatgggtggtcgttgtctccgtgagtatggtccgtttatcctaatgacttgttattggccaaaggtcctgagagccagactgtgggaatagctttcagagcctgggatgtattcccttcagtattctcagtgcagtcaaatgttgtccttggagagtggcttgatttttggagatagctaaaataattcaaaagtgggtttggtaattaaataaaatgatcaaactgagaaatatcaacacagtaaaaaaaataaagagtgctatgaagcatacaaaagtatatgaagtatatcaacacagtaaaaaaaaagaattctgtaatgtaaggcaacagacttaatttttttctgagctctcatatattgattccataagtgatcatctttttcactggtaaagttggctagttttcaaacaccaagattcagtgccaacatcaatgtgactgtcttacaatttgtgaactaccagtgaagttcattgtcttaggtgggttcctaaagaaggcaacccaagtcaagccaattaagggaatttcagcaagcaggtgattgctgtgggcagctgggactcattgcaatttggcacctctgggagcctctgtaggacacgcctcagagctctgtaagccaggaaacatggacgctggggggctcatctgctgattcccacctgccattcgctgagccctgcttctaggggtgtttgttggcactgctggcttgacccatcctgcatgtgggctgaatgtcccctcccagccagaaactaagcatacagacacagggttagcatgtcagtggtgaacagcctctgctgtgccatatgcaggagataggcacagagcactgcagcacctggtactttagtctgaatcagaactttctttgatgatggacatattctccctctgcactgtgcagtaatatagcttgaaataggactggaatatgactgaagaactaaatttttaatattatttaattttagtttaattttaaatagctacatacggttattggctaccatcatggatagtgaaagtctaaatagaatattagaaaatgaatccctcaaagtctcatagtctcaaagttaggaattaagagggctagaatgaaatgagtggtgtccacggatatatatccactgccccttaaatcttgtcttttctactttagctggatgggtttccagcttctcttagcccacagataggactttgtgtgctcagctgaagataattgctaattaatgaaattcaacagttttttcgaggaccactgtaggaaattgctgtggccctgcatcctagctctgcacacagagaacagtaattgctggagccttcagtgataaggaattcattcctgtaggactgcccaagtgcttgacttagcccagataaaggctgctcaggtaaatattgttgcaagggggttactggaattatgcctccagctcaatgcccatatttgaagatagtaatggttaggcaattttgcctagtcctttccagattcagtgtattgaccagctcttgacttttaaggtgaaataattgaagctggcaatcagatcactgggtcaagggtattcagaagattattcacacctgtttctgaaaagcatcctgcatgatcaacaattcattttaaattgagttagcatcaattaacttgtattgaaaatgggtaatgatgatgtagaacatacatgaccagtgtgtgggatatttgactcatttcatgccatctttctcccttattttgcccaagacagacattgctaatcaatcacagtgccctttcatgtggacccaccatatagcccctgggtctttcttaacacaacatctctggtacataattgcaagtccatcaagatgaatatgttcagtaagaaataattagtcatttctgtcataacataacaatgggtgattcagatatcacttagaagtaagactttaatagactacttgttgtttcttaactccagggagtgagggcaccagcattactgtgtatttcccctcttctctctctgtcctttaggccagggctcgggaaactacccccgtttttgtgaataaaggtttactggacatagcccatagacacacctgttggtttatgtgttatctgtggctgcttttgtggtagaacagtgcattcaagactgtttgacctgccaagcctaaaagatttactaccttgccctttatagaaaaagttttctgactcctgccctgggcattttttatttatttatttatttttttgagacggagtctcactctgtcacccaggctggcatgccgtggctcactgcaacctccgcctcccgggttcaagcgattctcatccctcagcttcctgagtagctggaattacaggcgcctgccaccacacctggataatttttgtatttttagtagagaccaggtttcaccatgttggccagactggtcttgaactcctggcctcaatctgcccccacttggcttcccaaagtgctgggattagaggcgtgagccactgtgcccgcccgccaccccccaccccccaccccccaccccctcctgccctggactcttattttgacttttatacagggagaaaaccactccttcctgttggcacagagagccacgttagattcgcctatgcttgtcctctcctagactgggtaaaaccggtaggccttactacttacaaaacttcctctttataaaatgtacacgaacatgctatgtggccatgatggaaattttaaatcccagcacatcatgttaattcattacagagacagaacttctcaagcatactctgtaagcatgtgagcttgggataagttgcccttgggttcatgttagcctctctgagtctgtttcttcatctttcatatgagaatattaaatcccaattcttgtgtgtggctgctgagataatgttgctgtgaagattaaattacaaagggactaaaagtgcttttcctagtacctcatacatattaacagtccacacatcggccgagcgcagtggctcacgcctgtaatcccagcactttgggaggctgaggcgagcggatcacttgaggtcaggagttcgagaccagcctgaccaaaatggagaaacctcgtctttactaaaaatacaaaattagccaggtgtggtggcacatgtctgtaatcccagctactcaggaggctgagacaggagaatcacttgaacctgggaggtggaggttgcggtgagctgaaatcacaccattgcactccagcctgggcaacaagagcgaaactccatctcaaaataagtaaataaataaataaataaattaattaattaattaaataaaagtccacacatggtagttcttcttgaagcagcatgttttagtaaataagatgatggacttgttatgagctcagaacaagctcatatttgccatgtgtcttggggaaagattctccatttatgccttgggaaccctattgttatcagttagctacagctgtataacaaactacgctaaaacatggtcgtttctaacgctaagcatttactatggcttatgagtccataggtcagctgggcagttatgttgctctgggccaggatcagctggtggttgctgagcttgttcatgcctctgtgatcatctggtggtcagcttggggctggctcgattaggatggcctctcatgtcttgtggttggctggcttttggctggcacttgcctctcatcactcagtagccagttgagacttgttcatagggtggtggcaggggtggcacagcatcacttccttcaattatcttgcccatatcaagtcacaaagatggcccatcttcaggggatagaggcaccacaggatgggaggagaaaaatccaattgcaaagggcgtggatacagggatgaatggagaactgggaagaaaaaaatgttgtaattatctatcacattggccccttcaccaagatggtaaaaaatatactgttttcctttaatagaaagaagctattaaataaagcttttcattaggaagtttcgcatggcaaagtcaagctctcccctgccctgtcactcttgctctggctttggtcagcagagcctctgacatggcaggaggttaatttgggtcctgcctcccagggtttgtctcttgtgtgacagggtcagcaaaccttggggcctgttggctggttgcatatcggatttcttcctctgacattctcacaagttccacagcccttggattggtttatgaaggagccctcatgtcctccacttctcagacgtgtggaactccctgaggctgtgtctgcagattgccactgagaccacttgagaagtgagaatcgtgtctgctcagtgcattgtcttggcctctgggatcaaggcctcctgtccaacctgcccatatgatcacaatgcctgttctatttcagccagttgtttggatgaactgttgagatgtatgaggcatttaagagcttggctctggagtcaaatgcaatgtggaaatctggctcctttacatgcagatgtgaccttgggcaagatgctgacctcaagggacttcaggttttacatcaatagaataggagtaataacagtgcttatgatatggggctgcgaaaattgcatgggcttgagaagcaccttacctgtgtgtgtggaataagccctcactcaatgatagaggttattagcacgattatttttatgactctgaccccaccatatatgacgagtttcacctcttcaaaggagtctctattacctttttttaaggctgggaaggcttagttttagcacatccatgggttgtcacagagatgtcatttttgattcacacagggatgttccacattttgaatgggatagctggtcctcagcaaagggacactgccaagattcggaagagctgtgaacttgctgagtcgtggagaagcattcttggacacatagcctgactctgtttgtaattaatttgaatgcttccagagcttccttttataccctccctgttgtaattccatggggagttcatcgggccgaagctgcagttcagatcattgcgttcagtgctcattcttaccatctgggcttcatttgagtggagggcagttattttttaggtatctagttttttttttccccttgtgcagcatctgtgggtgtttgtaccgcagaaggaagcatgtaaataaatgcacttgatgaagaatcagtaagaatattaattcctaagctatcactcagtctatataaccatttgtaaaagagaaaaatgtcatttcacttatttagctgttcaagaattctaatatttctcattttataaggaaaagtagaagaaacaggttaggaagactaaacccaaagtatgacagtgctagaagaaacagaaattgttaagtaaatgctggagttgcatttcacattgcctcccacatggtgttttagagagataccaccccgatctacctgctggggaaaagtgtgtccttaacccaaagcttccaagtttgccaagacttgggggctgagggccagaaaccaaccaggagatagggtaccagggtaacctggagacaaccctcatcagatgcatgtggacacctctccaagccagtaacattttactaagcatgtttgataaattaggcttaaccaacagcacattgggtagagagaagaagggaggaaggcagaggaattctagaaggaaaatgagtgagttccatataatctgcaaaagaattccttctggcagtttatgaaacgagatgtttgatgaaagtaacattctaaccaggaccctgcaccttggcagcctgtcttctgtctctgggacttggggcatgtgggggatccaaggggtgggctcaggtgttcaggtttgggatggtgttgtggattgaattgtgtcccttaaaagaagatatgttggcgtcttagtcctaacccccagtaactcacaatgtgaccttatttagagataaggtttttacagaggtaattaagttaaaatgagtttattagtatcgtactaattcagcatgccaggtgtcctgataaaaaggggacatatgaacacagacatgcacacagggagcactccatgtgaagataaaggcagttgctgggaggctgtgcctgcaagatgaggaaaaccaaagcttagcagcaaaccatcagaagctggagagaggcatgaaacaaattctccctaacaacctcagaaggaaccagctttgctgacaccttgatctaggacttctagcctccagaactgtcagagaatacgtttccatggtttaagccaatcagtctgtggtagtttttgacagcatccctagcaaacgaatacagatggtgtcgtgataaaaggcgtggatcttctcactgcatcaccccactttcctgtttccaccatccccacagcctgggcagggaggaagagtggggtgaagagaggccattgacaaaatttggggatcaggcattcccaggtcctccaacatgaggttgggaaccgcttggcaacttagattcctgtgtttcaaataaacatccagaaataacatgatgagctcagatttctgcctcttatcttgtcatctagtttttctgtttataacaaaaatggtaatatgaaaagtacagttgtatgatgtgatttgttgagggagcgacacagttgcacagggtaatttgtgtgcagatcacatgttatccccaccacgatggaatgaaggaggtctcattgggccccttttgtgaagcagctgacttgtacaggaggcagtgacttgtacacagtgaatgatagaaccacagttcaagttcaggactcttgatttgcttgcatgtaagctcttccctcctacctgtaggatgagtgcaccaaggtctggctgggatggcccagagagttctgaaaatacagatgcctgaaccatccccagaggggctgaactaattggtctgggatgtggtctgggtagcgggagtttttgagtcttccaggtggatacccaccacagtaggcaaaccagcaaagcattttaggttgacagcagcctggagaggttagcttattcagaagttctcaggggcttgtgacaatccccgggaaagccattcctaaaatacagattcctgggacctgcccagacataacagatcagaatttccaggagtggagtccaggaatctgtattttacaaaaggcccagaggtcatctgaggatcacgtaggtttgggaactggacctagtccatccactgtgcctgtggggtgtgttctggagggattctaggcagtaaagcactctgttgttttcacttaaagcctgcgctgtaacaccttaccagaaacaaggtcatctgcttacttcacagattccaggggtaaatatagtgtcacactaggaaggactcaggactcaagacagagtaaacacttcttcactcagcaactgggcacagctcccagccacccaggaacgctaatttggcattaaacagagacttgcagaagtcccccaaatagcagcagtttcccatcctgtagacccacagaatacagcctttttgatatcctctgtctcagttcttcattctgcaaatgaagaagttgaagccaatgaaggtatgaccatctaatctctgtgacaggcagatcttggatgccctctgcaatgggcagctcctagtgccagctgctgtgtccttgtcattgtctctgtgtgtttctgaccctggactcatctggctgcaattcagtggccacatttgtagatacaatacctatttttgaagtatttttgaagagtaaatgagatagcattaaaagcactttaatagtttataaaatactagttgttgttattgttgaaatgtcagtttgcattagattgatatggaaacttaaggtggggcaccaactttgatttgtacctgtaagaatagtcatgtaacaatattgtttgtggatctggttcccttttgccagtctttaaaaaatttcctaatgcaatgccctattcagtgagttaagctaattatctatctgttctcctggagcttaaagccaagacagaaaatactggcagtggcaaagatgactgggccattggccagagtggatccattgataaatccatttttatgtcttgcccaagcactgtgggaaactggaacagaaccatgggacctatactctgccagtgttccaaaaatcaggtcctaggcattcatcatggcaaatttctgctgagttggccatgttaatctttggacagatcagatgtttaagatcatattcaattatacagcaatcatacattggaatatgggaaactcattataaattaggttgttgaatattgaaagacatgggaatttatttatgacaactgttttaggtgcaaaaagcaagctgcaacatggaaatgtatgtaccaaatgttaagaaggagtttctagtggaagaaggagtgtctttttattttcatctttgtatctcttggcattttttaaagaaatgccaattcttccagatgaaggtggcttgacggaagagataacgtcgaaggtgggtctttgatagatgtataagagtttgaaaaggcagaagcgccgggcacggtggcccacgcctgtaatcctagcactttgggaggctgaggcaggaggatcacgaggtgaggagattgagaccatcctggctaacatggtgaaaccccgtctctactaaaatacaaaatagttagctgggcgtggtggcaggtgcctgtagtcccagctactcgggaggctgaggcaggagaatggtgtgaacccaggaggcggagcttgcagtgagccgagatcatgccactgcactccagcctgggtgacagaacgagactccatctcaaaaaaaaaaaaaaagaaaaaagaaaaagaaaaagaaaaggcagaaaaatcatccagaggaatgagagtagcatttgtggaggcatggagtagtgaaatcccatagtttgttctggaactggctggctgttccagctggaccacattcagatggctgactggttatcaaggcaatgtaccactgagactgagagcagtttgtttgacccacacaacctgagtttgagtcttggctttaccatttcaattgtgtgaccttgggcaagtcagtttacatcacctactctatgtgttttcatgtgtaatatgtggataataaaaggaccaaggtatgggggaaggttaaatgaattaacacacgtgaagcaattagacccctcacctggagcatagtgagtgcttcataatttagtctatcgtatctcatcattacggcagatattgttttgcacccagtagaaatgtacagccttacttctctgagagttgaaggagaaaaaaaaaatggtgagttggaagtaatacttcatggagtacagggtctctgtggggctgtttggaattgtgcagacagagggaagacaggagggcattgccatgagagggtggcaccaagtgagagcaattcttctgagctcaagatttaaagccagttctagttggagcagaaagagggactggaaagtgttaggaaataatgttggatgcattcaatgaagccagattatagagggccttatggaccagttggtaggcgtctcactcataaaaaggaaaaggggactaggacatgatttttacaggtgatatacgcctggtggaaatgttacagcataaagggcctggactcggacttgttttctaaagccatcgggtgatatttcctgtggacctcacctgtagccagtaatgatctggaaatatttcagaccttagtaatagaccctggtttctgcacctagaaagaaccatggtggacttttcttctgaacattggtttctgacttggggaaagcagatgagtatctgtgaacacctcctccttcagtgaataaagagaacaatggtggatgatggaaagagcagtgaacatgttgcagccacaataaagtgtattgctaattcattttttaaaatgtgtttgtcttcttactttccttgattttttactaccacattatttttgaagtttaataatatggttgagatatatgactagctgggtttctagtggatatgatactctgtctctgagcagtacttgcgagcattctgaatcctagccttttacacctttagatagagtgaaaccataactacatatgtacatggcttggtcttgggttggggttcccaaagaaaagactctgagactagcatttaaattcagtagtttatttaggaggtagttgcaagaggcactggtagcagagtgggaagtgagacaggcaagggcaggaagccaaaaaagatgtgataataagtaagtcacttctgtggacaatggggattcaacccactcagtggcttgggaggcggggaggactgggacactgcagacagtataccacaggcttgtctcccaaaataggtgagaatactgtggagcatttatttaccaactcctgtctgctattggttgacgtttgcttctggagaaattaactccccagcactcctggcttctccacataatggatggagcctggtctgtggccagagaaagctcccagacaaggaagattgaatgccaagggaaaatgtgtagagcacctactactccacgtcacatggagggcttaacagtgaaagtaatggtgagaaactagatactttacccctaagatcagaaataaggcaaaaatgtccgttctcatcattcttatttgacatcatactggaagccctagacaatgtagtgagaccagaaaagcaaagaaaagacacactgatttggaagaaagaaataaactggttttgttcacagctgacacgattgcctgtagaacgtctcaaagaattgataaaaatctccaggaactaataagtaattataacaaggttgcaggatacaaagacacaggagttgattgctttcctatatgccaggaatggagaattagaagagtataattctaacaaaatatatacaagactgatatgaaaaaactgccaaactctgatgaaagaaatcaaaaaaagaactaaatggatattccatgttcatgaataggaagagtcagagtcaagttcttcccaacgtgttctatactttcaatgtaattgtagtaaaaatctcagtaatttattttgtggatatccacaaagtgatttctaaagtttatattgaaaggcaaaaggcccagaataaccaaaacaatactgaagaagaacaaaatcagaggactgacactatgagacttcaacactcactgtaaagctacggtaatcaagacaatgtggtattggtaaaagaaggactaatatccagaatctacaaagaactccaacaaatgagcaagaaaaaaacaaacaatcccatcaaaaagtgggctaaggacataaatagacatttctcaaaagaagatatacaaatggccaacaagcatttggaaaaatgctcaacatcactaattatcagggaaatgcaaatcaaaaccacaatgcaataccacctcactcctgcaggaatgaccataatcaagaataaaaaaagagtagacgttggcgtggatgtagtgaaaagggaacacttttacacggttggtgggaaggtaaaatagtaccaccactatggaaaacagtgtggagattccttaaaggactaaaagtagatttatcgtttgatccagcaatcccactactaggtatctacccagaggaagtcattatacaaaaaagatagttgtacatgcatgtttatagcagcacaatttgcaattgcaaaaatatgcacccagcccaaatgcccatcaatcaatgaataaagaaaactatatatatatatatatatatatatatatatatatatatatatatggtgtgtgtgtgtgtgtatatatatatatggtgtgtgtatatatatatggtgtatatatatggtatatatatatggtgtatatatatatatggtatatatatatggtgtatatgtatatatggtatatatatatggtgtatatatatatggtatatatatatggtgtatatatatatggtatatatatatggtgtatatatatatatggtatatatatatggtgtatatatatatggtatatatatggtgtatatatatgtggtgtatatatatggtatatatatggtgtatatatatggtatatatatggtgtgtgtatatatggtgtatatatacacacaccatataccatggaatactactcagccataaaaaggaatgaaataatggcataatgaaaaggaatgaataatggcataatggtattagctgcaacctgtgtggaattagagactattattcaaagtgaagtaactcaggaatggaaaagcaaacatcatatgttctcactcatatgtgggagctaagctatgaggatgcaaaggcataagaatgatacattggactttgggaactcaggggaaagggtgggagttgtcgagggataaaagactacacattggatacggtgtacactgctcgggtgatgggtgcacagaaatctcagaaatcaccactgaagaaattattcatgtaaccaaacaccacctgatccccaaaacctattgaaataaaaagtaataaaaaaagaaaagaagagtaattatataaagatcactgtttaaacacacaaacagtaaaagaataaacaaataggctaatagaacaggatagacagccccaaatttggaagcaaccaagatgtgcttcaacagatacataaataaactatggtacagacatacaatggaatgttattcagtgatatgaagaaatgagccatcaagccacaaaaagacatttaggaacttttaatgcatattgctcagcaaaagaagccaatttgaaagggttatatattgtatgattccaactatgtgacattttggaaaagataaaactgtacagacagtagaaagataagtagttgcttggggctccaggggtagggaggaaggagggataactaggtggagtgtagagggtttttaaggtggcaaaactattctcttatgatactgtaatgatggatacatgacattacatattttcaaaactcataaaatgtagaacatcaaaggctgaccctaatgttagccatgcacctcagttaataataatgtatcaatattggttaatcagttgttacaaatgtacctcaccaatgcaagatgttagtaataggggaaactggttatcgggggagcatttgggaactctgtacattctgttcagcttttcccaaaaccactctaaatttgttaagaccttattttaaggtctattgacaaatgacaagaaaaaaattatgtaaattggagttttaaaaattagtatttgtgattattaacttacaaaataaattggaacagaattcatggtttgcttgttaaaaaatgagttctgtttgaaagacaaaagggcgacattatagaaatggaaaatactgtgtttgaggttgtgcatggtgtagtggaaggccacagttcaggggctggtcactctgtgtttgagtcccctccagcccgtttctgagaagtactgggacttcaaattagttacaactaagcttcggacttcacatctgcaaagtgaggatagggagacctacttgatggggttgttgtgaaggtgaagagagaggaagtctgtcaaagcaattaaacaacacccggcatgtggagctctgtgcctcgccctgcttcgaaacctttcctggtgctgacctgaatgtttctctctgattcggtcaacagttgtgccatttttggctagtgatctgtggctgggctgccagccgatgacaggcagttccccaagcaggtcacaacaaggtggcaattgaccttgctccccgaggatgtctgttcgggttctgctagaagccaagggctccctgatgtggggtttcggtttcacactgtggcactctgaacaattctttatgggctggcaaaaggcgtttcacacttcagataggccccaggaggatgatttgctttcttcaaggagaactgagaattctcagatgattggaaggttctgtactctcattttagcacctccgatagattctcccacatgtggcaaacacagtcatagctggaggtccattgtcggttgttaacaggcagtgaactgttgctgaatcagacagtccacgtatagggcatttccatcatcacagaaagttctgttggtcagagcatctaaagcatattcggcctctccccctagccaccctgtttatctcttgcttgcattcctccttggtatttgtgctgctgccaccccagttccagcccccaatgcctaataacatcctgatagatcaatagagttgtgttttagcaggtctaacatcatgttgtatctctggcctctcaaatggcagagctactcctctgcttggtgcttaaggcctcatcagggccctgaccgcctgtgtcaccttacagtctccatcctccaggatatgccgaggagtgcatggagtgcacacacagactgcttgctgtttattgagtaagctttgtcagtctgtgctaggtctgtttcacaatccactctccatctgccctggtcaaactcttctccattgtgtatctgcttcttatatatcaccagagacaatttctccctcaggtaaacacctgaatacttcaggtttcccttccacgtgacacccagcatatcctgcttcatatgcaatttgtctgtctgcatcccccagccttgcttcttcctggagtgcttgttcctttaggaacaggtgctctaggccttcttctgtgtaggctagcccagcaatacataattaccaagcaatacatacttggtaaattgtaagatgctttttccaagatacaatttctaaatttcttctctaagaagttctttcctaaacttccataggaacaagccagcatacttgcattgactccacattgggagactacagaatcgctccctcaagcaatcctctctccttgcatcagtctcctgtctctgtgcctctagactaacattcagccacactagctgagtgtccccttctgcagactaggaggattgggttgtgtattagacactgtccatgcctagttcgtatctcttaggcgttactacttagtatgtattatcagagcctcccattgcctgaacctgaatctctttgcctgagggttctgggagacttctccaatccctaagaggaccacaccacctgcccctcaaagcagaccagaagttccaggagaatgaagacccctgagaaaagtccttgaccaagaactgatgagtcagtgtgtaaatatcccagttcccttgcctattcgatgggatggctctgaggtgcatgctctgtgtggttttctggaggcccccagcaggatggagcttcagttgcccacagcagtaactggcttgataaattactttgttgactcctttgttggctcctttattccctatccctttctcctcacatgtatctttgtcttaagctctacttctgaggaacccaaattcagattgaatgactcccaagtaatcttcctttccaactctctggctgctttggtttttatcatcctttgatttgctctggttggtgttttgcctacacaggttaccactgtgtggcatatgtttctaagcttcagatgaaattattgtttcactcatgtcacaagactaatccttgtaaatggcgtgtccaaccagggacccagcagggtgagacgcaaacctcgagagcacgggcaccgttggaggcctccaggagtcctggagaagacagtgcagagaagctcttggctgcagtagctctaccttaagccagggattactgagagttacccactctgctatttataaggactgaattcatagctagggagtttatatatgaataatgggaaataacttttttatgtgatatttcattttgttctgtagttggtaaaaagagcactttattaaaatagaatttggtagatgagatcaaagttaccttgaaaaattacttttacaaatttatttctgtctgagtttgctcctacttttcttaattctgactctcctattctttcttttcattcttctccttccttttctttctgcctctctttttatgatgactttttgtgctattgcatttaggaaacattaaggtattttctttttgaaatgcacatacacatggtatcatttaccagtttagcttttgaatctattggaagattctaaacaaaaagatatgtgttgctgtctctttgccactacgcctgccagacatcaatagtcaattgtagcatcattctcaatcttgagctccagggcaccatggtaattgatgggtatcagcataggagaggaaactgttatgatctaatggaaatgattagattaggtagaccaatgtaggcagatacttgatattcttttcctttcatttgtcctttgttaggagaaggagactgaatgattacttcagaagaagggaggttcttggacaaattcttgagttccatgggttgtgagtctgtcttgggtacagaccgtgctgtttctcatccatcttggagaactccaagaaagagtagaaccacaagctggatgttccactcacctctgtccaggccccagtggcagtttaattctcaatatggacagataggatgcttaccttttctctcctcctgtagactttatacatattaatgccctggctttccccatggcccagcctccattattgacattacctgtccttagatgctttgatgtttggctgtctttttgatggtggccaatggtccaggcccagggctggcctccatagggtctcttgggagggtgatagagaggagacagttccctatgtcaacaccttatctcagtcctccccagaaccttggccttgtcactgctgcagtctgaagttctcattttcccttcaggttgttggatttcctcatacacccaaacgtggggatcatctcccactcctaaatacttttgcaaagctgaagcttgttgttgctatttcctctctatttcaccttcacatcatcagcagacagtatcatcgcctgcctgtgggcttagctgcttttctctaggtctgaatgtgtgatgaaacaagagctcttccctctgactttgtgaccatctccctccccagcttctccttccctcttggccttatgtcctggcctgcgagtcaacttggagagcttttccaatttttgctgtggaacctaagttaagtgattaagcttcccatgggcccttgtgtgtccaacaacagggttagtaacgttttcctctcccagcctcccctaggactcctttcctggggtatctgtcagcatcttttatcgatagttggactggaggtttggctttgtcagctctcttctgaacactccccaaggcttcatgcacttcacctcagtttccaccaggtggttagtttgaagcaggctgaacacagtaatatccagagactccatgggtttgatcaaacacagaatgtgtagaaaatgccttcatctgggatgctttcacactccagtggttagagagcacagcttcaaaacaaaaagttagcctttgtgccattaatgcattgtgaaggaaatggtgcccctcaagttcctgggtgtcataggtggggctcctacaagcagagcctgaggtgaggactccggagcctgtgttttattgagggagagctctcaggggataccgatgaaggagggagagaagcaggacagggcaggggaggggctgcacagggaggatgagggggtagcagggcagctcagccttggcctgaaccattgtcggtgggaggggcggggagggggtagttctgtggcttaaattacacccaaagttgcctttcttgagtcaagggccttagcatttgtacttaaagtggtcggtcattgaaagcccccagggcagagtgggggtacagccttcgatgaggccctatccagggggccctattgatgaagggcagttctgcagagagtctcagctttagccctgcactcacagtagctggcactgcggtaccaaccactaagagagacctgggccagcaccaacggcagcaactacccaagccttcttggctcacgacaaaggaaactaacattattaacggctgctgtgagtaggtgcagtgtggagagcttctacacccatctcctcatttgattattgaaacagcccttaaacacgttattatttttcctgattttcaaatgaagactctgagcctcagggattcaggaacttcctaaggtctaaactgtaagcagaagagttggaatttgaactcagatccctctttcttggtttctcaccccaaagcccaagtccgcattgaaccttaaggttaaattgctgcctggaccagagacacttgtttcaacatgtgaagtctcagctgttggtggggaagagacattgtgtaggaatttcctgtacaatcatcttttaaagtctttaaggtcatcactcagggctatttgcttttattgtcatgtgtcttgtaccaacattttgtcaatgatggaccacttatgcaatggtggtcccataagattataatggagctgagaaaaccttatcaccgagtgacatcacagctgttgtaatgtcatagcataatgcattatcttttctatgttgagatacacttagatacacaaaatacttgccatggtgttccagttgcctggagtattcagtgcactgtcgtgctatacaggtttgtagcctaggagcaataggctatacctcatagcctaggtgtatagtaggctatactagctaggtttgtgtaagtatgctctatgatgttcgacaaccatgaaatcatcaaaagatgcatttttcagaacacgtcttcatcattaagtgatgcatgactgtatttatacagttgtaaatttagaagtcaaaacaaacttctatgtcagctccccaaacaagcccacagtagattcaaatcaccagtttggaaggtaggtcatctacaggcagggggaagctgaagatttgatatgaaaggagagacagtttaatcatagctatttaaaaaaaaatagtcttgggccattcagttagagaaagctgctgctttacactctttagtaggtgacaaatatgtcatcagattacatcctagaattaactggaatctgtttgctcatcttttttcaatagacttattgagtaccttcagtgtgtcagaaactgtgctagagatgcaagaactattaagacatgatccttgtgcataaagagcttgcatcttaaaagcttgaacacaaggaggctgcagaggaagacagagcaagcacctctcctgagcagagttctttatcacattagccagactaataaaaatgcatgacctgatacactcataaaaggatgttcaacatcattagtcactgggaaatgaaaattaaaattgccatgagatagtactgcactagagttgctcaagtttaaaagctgacaataccaagtcttgtcaaggatgtgaagactctggactctaatatatggttgatggacatgtaagatggtgcagctatcttggaaaacagtttggagtttcttataagacatatgaaccagccattccacccttaggtatttacccaagataaatgaaaatatatggttaccaaaaagatgttcacatgaatgtttatagcaattttattctaatagctccaaactagaaaaatccagatgtcctccaactggtaaatgaacagttagaggcacatccatgcaatggaaagctactcaatagtttcaaagaatgcacccctgaaacccacaaccgcatgaacggacctcacagacatcatactattcttgagctgaagctgcagtgtaaaaataaaattaagtttaaaaataattagaaataagtaatttgaaaacagaaaaaaataatttaaaaacatgccaaatgaaaggaaccagacacaaaagaatacatgctttgtgattctagttgtatgagagtctaggaaatgcaaacgaggcaataggagcagaaagcagctcagtaatgttatgggggtcaggtgcagggggttggcctacagaggaggacaagaaacttccagggatggcagaattgtacactttaagtggctgcagtttattttatgtaaattatacctcaataaaattcatttttcaaaaagcacctagaagcatgcccaacacatagcaaatggtcaataaatggtggacttcataaaaaatttgtgtatgtgtgtgtgtgtgtgtgtgtgtgtgtgtgtgtgtatgtgtgtatgacccagtaagctcatagaatgatgttcaacatcattagtcattaggaaatgaagattaaaactacatgagatcatgtagtactagtgcagtagtactgcactagagtggcttaagtttaaaagttgacaataccaagtcttctcaaggatgtgtagcaaccaggctctaatatatggttgatagaaatgtacgatggtacagctaccttggaaaacagtttggaattctcccaatgcatgctaggttcttgccagcctctcccctcagataagtcacttctcctcctttgggcagcagcaaggtacagaaacttcaagctcttccctgtaaggcaaaaatgccaactccaactcaccttcttggtggcctcttagcatcagagaaggctacttcctgacaaaagcaattgtgttctctgtttcatcttggcttccttatgacccctttcagacttatcaggactgtgtgccactcctcagactgggctgagtcaggaacccagccggctctccatgcctgtcctccacatggcatcagaagggaggaagctacatgtggttccaatcactgcattacagactcagcctttatgcccttcattgtgtttggtttggaggccccctcgcagactttatccactagctcggttcttatgttaaatttatgtctgggttcagaacacttcacatgataaccactgattaaaatccaaaaaatgagacagaaagaagacaggataagaaggatgacacattcgaaaataagtgatcttaattcctgggctcaacattctccatctgctaagataaacaagtgcaacttcctttgcctccttacattgtgatttgattcttctctctggcctctacctggagctgtaggacccccagggtgttagccactgacctgaccactggacccttggagaatccccagcccttctggaatgtgcagggatttctaactccatgacattttggtgaagaattttattttcaaaaacatagcataaaatagaacaacagcaggtatttccaacctatagtgaataaacaacctggtggtgaaggaatgtatatgcttctttatccgcacattagtggcaagatctggtagtgagcctaataactcctgtcagtttgaattgttgatgagcataaatgctattttgagatgcctgctacattgtaatgggctgtaaaatacctgactgccgttgatgataaagtcatggaaattgctaacactgtgtggtgtgctgcctacattcatattagaaggaactgctacatttgggttagaagttatttaaaaacatatgtattttgctcaattcactttagagaccccctaaattctacccatagtcacctagggggtctatagaccccaaattaagaacccttggaattaggaccaaactctgccacctgccaggtattctcactgagatgagtgacctgtcaccactcctgccaacagcatatgccacctcctaaattatttttaaaaagtgataaaacatttcagatacaaaaacatatagggagtaacataatgaatatccatatactcatcattcacctaagacataaactgtttgcaaatgtattttgaaatcccctgcagacttgtcactgcacacagtttcaatctgttcctttctcccaagggcaactactaactagaattgtcttttggattcctgtatgtatccttatgccttttccacaaatgtatgtacccatgaacaatgccaagtatcagctgcatgtttttaaactttgagtgaatgagattgtgctatgtgtattctcctgcaatgtgctttttcctcttgacattatttttgtgaggtttatctgtgtcgctgtatgggaccccagttcacttattctcaatttgcatggtgtcctatagtgtggctctaccacaggtaagctagctattttgttgttgattgacatttggattgtttccagttcttcacatgacagtactccacagaacattcttgtgggtgtctcctggtgggatgaatttgtctatcagtggaatggctggggaataaggtatgtgcatccttggtatctacaggttctaccaaactgttctccagcatgtttcttccgatagatttacactttgactagcaggggatgcaagttcctactgctctacatggtcatcagtacttcatattctcagactttgcattaataataataataataataataattcctgcagtctgatgatgtgaaatggtatttcaatgtggttttaatttgacttccctggttactggttataataatataaattgtgcccccaaagagagaaggtcctaatccctggaacctgtgaatattgctttggtaaattattttgcaggtgtggttcagttaaggatcttgaaatgaagagattatcttggattatctgggtgggccctaaatgtgatcacaagcatccttgtaagagagaggcagtgggagattagacacacaagaagatatgaaggtggaggcagagattggggtgatgcagtcacaagccaagggatgctggcagcccccagaagctgagacaggcaaggaacagattccttcttagagcttctggagggggcatggctctgctgacaccttcggtttggacttctggcctccagaactgtgagaggctacatttctgttgttttaagggacacagtttggggtaatttgttccggaagcctaggaagcaaattcatggatcaaattcagcttctgttcacaagtctattgggcatagggatggcctcttctgtggattgattattcatcaacattgcctattttttcttattaactgtaagagaacttgctgcattatggatattaattctttcttgttactatgttttgtccatggcttgtcttttctgtttttggtggtggtttttttatatacagaagttttaaactttaatgtagtcagtgtgccatttcttcttcttattgatttgtgtcaggtcttgattgaaaagtccttactgtcctgaaattggagatacatacatatcctgttattgtccgctaagtatctcctgctgtgttggggcatggccagcccttgcctcttgggtgagagaccccagctgggaaggggctgccttgcccttcagataatgggcaaagccatgcagatatcccagggaacctgctagagcacactggactgggagggggtgttggctctttcaaaccttaattttgccaaatggccatgctaatgattttgatattgagtttttgtagatatcgacttctctgttgctaacctgtgctttttaatcatcacttaccatttaccacttttcagttcagttaccaccaccgtaggtccaatgaaggcagatgtgccctccagctcagctatatgttgtcagggttgttttccctcctgctccaaggttgtcttcattttcacatagttaattatttgcagtgcctaaaattccagtcatgacagttttgtttagtattttcctgtcaaaaatccagattgcaggccatgacctggggtgcctttgggctgaggcaggtgatacatgagcaaggaggtgagtgagtgaccttagggacagctgcggagggcaggcccccgaggtctaagattggactcaacatccacccgcgccacatctgggccctgggctccttgctggatggcctgttatagacctccactatggaaactttggtctcattttgggaaaaaggagactagagcctctagcagaggaaatgacccctcttgatactttttgcaaccctgaccaagtcattaactgccctgcatctttcttgagctttcaaatgggattacagatgagtgtatttttaaggccccttccagcacctaaaaagtgtccagtgatacttaagaaatccaaaggtgtccagtttcacagacttatatcttccttttaagaaaacatggtgtaaagtatgcataatgtaaaatgtactatgttactcattttaaggtgtacgatttagtagtatttagtacattcacgttgctgtacaaccatcacagaacttttaccaccccaagggatattctgtatccgttagcagtcgctccccacttccccagttcccaggcccccggcagtcaccaatctgtgttccttctgtatggattagtctagattggatatttcatataaatggaatcatacaatttatggctttttgtgtctggcttatttcacttagtatcatgttttcagggttcatccattttgtagcatgtgtcagcacttcattcacttttataactgaatgatagtccactgtgtgcatatatcacattttgttaatccattcattcattggtggacatttgggtgtttccaccttatgcctatagtaaatagtgctactgtgaacatttgtgtacaggttttggtttgaacacctgaatttacttcttttaggtatattcccaggagtggaactgtggggcaatgtagtaattttatgattgatttgttgagggactgccaaactgttttccatgacagctgcgccatttgtgtttttcttgatgaactgtgtccccaattaaaaaaaaagttcttgttctttcaaatttcccatgtttatgattcctctgttcctaaaagaatccttaatttattcccacccagagattccaggaaatatttcctatgaatggcctgtgtagcttttcagtaccttctctccccactgaggagccatactgggggctgccccaaaagagagctgccaacccgtcacccatgtcatctgggtgcagagggtgagaagcagcccttccaggtccctgtgtgatgggaggtgggtaaagtcagggaaaatgagcatgtcctcaatctgggaaggatgttgatagagattgaggcacctccatagatttctatcctcccagtgacccctgcttctcaaggggcaagtccccagccccaggtgcctcagccacccttacagattgtaggtggttacccgacagtctacagagaaaaatatgtctcttttagcaggggtgggtgttctggctctgctttctgactgtttggagacaggactggtcctttggggatggcttagttagggtccaaaattgtttgggaggtaatcccaggaaacacccatagggagtgttaccactgaggacagcttgggctcagtttcgatgactaccctctgggagacagtgtagaaccctcagtgttgaggcactaataggtgaggaaggtggggtatttatcccccaaatctcatcctaccttggttgaggatcactcctgaggtctgtcagtccagtctacacatgtaaagtcttagcacactcctagggccagagaacatcctcaggcagaaagatgcaggaagccataggcatgaatggaaactggggagacctccaacagtgctaacaccgtgctaatagcaaagaggtgtgtaagaagaatttgacagatattgcccagaaatgatcagtatctatatcttgggttttgctgataccatcttatgtttgcagtcagacacgaatgagaaggtcttaacatctcaacatgtcagtgagtcaactgatcctgtcgatgtctgtacaagtcaacatgcaaaaatctcaacagccacatcttcaaatgcctccacatctgggcctgtgaatatctcaaaactttaacatgcaaatgacccaatatctcaacatgagaatgtccctacatcttaacatgtggatgtcacatcaacagctgaatctgtgaatgtcaacatttcagcatgtgaatacttcaacatttcaacatggggatgccacctgtgaataatatgccaacttctcaacatgaaaatgtctcagcatggaaattttatggcatctgaatctatggatacctcaaagcttcaatatgtaaatgtcttggtatcttaacatgtggatattacaacatctgaacctgtgaatgtctacacataacaacatgcaaatgttttgatgtctcaacatgtgattgtcaacatctcagcaatgtctagacatcacagcacatgtgacaacaccacaactccaaaaggttgagtgagccattatctttcttctcaatccaattcctcaaaaccctattgaagtactagcatgcagaaattttttttttttttttgagacggagtctcgctctgtcggccaggctggagtgcagtggcacaatctcggctcactgcaagctctgcctccagggttcacgccgttctcctgcctcagcctcccgagtagctgggactacaggtgcccgccaccatgcctggctaatttttttgtatttttagtagagacgggatttcaccgtgttagccaggatggtctcgatctcctgacctcgtgatccacctgccttggcctcccaaagtgctgggattacaggcgtgaaccactgcacccggccagaaattttaactcttgtagacattctgttcttttgcagatcagcactggctctcacatgtggaaagatatctgctaaagctttgcaacaatccatcagcactgcactacatttatatggaaatgaggctgctggatatctcagatgcttccagatctttgttgggaaaagaccaccctgagacccatccagtttcctgatagtggctttagaatccctctcacaatcccatccagatagttgcagataaaatgaggctacagattagaaacagaacctctgacacttgtaaagagacagttgactgcagagggaagaaaaggaaaagctgtagaaagtaggatcctaaggaagtgacagtgggattgactaggacaagccccaaggaacttcctgggacacagcaatactctttattttgatagagctttgggttacacaggtgcattccttgtcaaaactagattcagatcacttcagatttgtacattttattgtatgtttttgaattgtatctcagcagaaaaatactgtaaacaaatattgatatgatatgcttgctgaagtattcagggaaaagtgtgttgatgttggcaatatattttgaaatgtattttttaaaagattgatgggtgggtagttaaatatatttgtgaaaaaacaagtattttacaatgttgtcatagaatctaggtgctgggtaacattttttcaacttttatacatatcttaaaattttcctaataaaatattccaaaagaaaatctaggctgggaaaactaacaagttcagcctttgggggttgctctacccacatcacagactctgagaatgcctctcagtcgtatctcgttttcatgcctgatactcattaatgggctgggttatttttagaaatcttaagttctggttcatgtgtagtaaagacagcaaaaatgcatgtaattgcttctggaaattttccattaaaaataactgcattagaaaaaagtggattcttaattaggggtaagccttagatacttggaaaatcccacttaagtgaaatctcgcattctctggcaacatagacgcaggagatgttattttaattagcatttctagttagtgggtgatcccatcagcttacctttatcctggctttatcatttccagggcatttttacatgtatcacctcagagttttagagaaagggtttttgagctagagctgcctgagtttgaactctagtgtgaccacctgctgggtgtgtgaccgtgaagtcacttcttgatttgtttgagctcagcgctttttcgtgacaagtggaaatggtaatatctaaaacacaggcttcttataggaaataaataattcaggcaaagcagattaaagggcctgatcggccataggtacttaatgagatggtgttctcggcttcagttactttgatgcagtcaccatgacgtttctgtgaaggaggagaatgaatattggtttatcgtttcccagacgagatagccgatgtttggagaatttcagttacctgcagaccaccaaccatgtgggtctcccaaagtagaaggaggacttgaaccgacgtctcctgtgtcccctgctgtttctacttcagccatgctccctacacccccgagtctgatgggacagtcacacaaacagaataaggggtacaaagatgaactgagctggaatctccatgggtctcggggcaaaaataaggttgccttatgcttttgggtgtcacagaaagttttgttgaaaattattaatatccatgattgaacaatgaaaatgtagctgaaatcactcagcaaacttgctgtgccgttttcaaacacggttaagtatttgggcttcccatgtgtcgctgggaaagcttgacttagggctacaactgccaaaacgttgaaatcacaggataggaactgacaggtgttttcctggcctgtgagctccccaggtggagatgctccatgtttgcacgtcctgctgctcgtcactccatcccccgaggcccctcacttcccacctgacagcaagcactggtgaggaagattggggcatgggttgagtgcacaagcatggatcagtagggcaacaatggcctttcgaagggccgtgggcccttttgttccccttttttggccaaagctgtggagttcccacacaccacaaggaagaatagctgtattacttgccagaccattctcccaggacatcaaatctgcctcagacctggtcattggacagctttatgcagatatctaagttctaatgaagactttcccgtcttcttaagttcattatccagaattggccaccagccttattttagaataaaagaagaaaacacatatccattggaaaatcatgtcagctgtttgagtgctctatcaatgctgaaagggagagccctggagcccagcatgtgtctgctggggatgcccattcatggtgctctatggcaagagagagaccatgagaggaacaaaatacactcacaccaaccctgggagagacgctgtggccaaagaacacacaccctcgtgtggcttattgtttttagagcatgctagagaactacaacagactgtttggagccttaacaatcgcttattttgtattggatgttttaaaaaagcaaaggatttttttctttgtatgttacacgtatgccaggaaaaatagttcctgcagaatgaaaacaacatgagggccagtttgcaacttgagaggggccattgggtccaattgcaaagatgccattttctctgaagcaatgaggctgagtgtctgtggggagacagacttggtcaggcaggtgggcttgatgtcagatgattggctgtctttagggagggcccagtcagatcttcggtgggaactgcagatacagtaatgaccttgcccctggccagcaggaacatgggctcctgaaaaactggtttccagaacctaatgggaaacagagctgtgctgtcccacagcctggggtggtgggttttatcgtttccaagaggagatatctggtgtttggagaagttcagttacctgcagatcaccaaccgtgtgggtctcccaaagtagatggaggacttgaacccacgtttttgtatcccctgctgcttccacttcagccagccgcccccctcccctgagtctgatgggacagtcatgaaaacagaatgaggggaatgaggggtacaaagatggactgaactgggatctccgttgatctcagggcaaccttatttttgccctgagaccaacagattccagttcaggaataaggtgtccacacacggctctaggttcctcaagaacagttaacttttttttctttcttgagatagggtgtcactctgtcacccaggctggagggcagtggtgcagtcatgtttcactgcagcatcaaactcccgggctcagttgattctctacttcagcctcccgagtagctaggactacaggtgtgcaccatcatgcctggttaatttctgtattttttgtagacgtggggttttgccatgttgcccaggctggtctcaaactcctggactcaagctatcctcctgccttggtctcccaacatgctgggattacaggcatgagccaccgtacctggccaagagtggttaactttcaaagttcaccttgcctcagcatccccagggctgggttgggaaacccacccagacctcaggttttctctgggcagtgccattatctgcagggtcaagaaactaggccctaccagaaaagtaggcacggaggagcagcaggagaaatgaaaggaagaaagccagaaaagtaagttctaagaactaagtaagttcacccagggatgcatcaggcagcctccatgtggaccacagagaggggatccaagaaccttgtgcacatcatctgttgagaatgagaccctccccatggctactccatagagccatgcagctgtgccaggatgctctcccatgaggccttgcactttgtaccgttatacaaggagaaggatgctcacctactggccccttcagcttgactttccctcaagccaacttctggggtgataggaatccttaaagcagagtttctcaaagagagtttccaggaccaacagtgtcagcttcccctgggagaagcttgtgaaaaatgcacattctcaggccccaccccatacccagtgaatcaggaactctggaggtgggccccaggatctgagtttcccaagccctccaggtgagcctggttctagatacacagctgtagaggaaccacgatagctcctgcagaaaacagattgggtggggattccactgtggggcgtttctttaatctctttcacattctacactctttagcagagtttctatatgggaatgcattaggaacatgtgaggcagtgatctggctgataaggggcactaggggatttttttttgaagttgctatacagaaaagcacatggttattacttaaatgatatgttgtagatcaataaaaaatgataaaatgttgtaaatgatgcctttgttcacactttacgtaagagtgagtaaatgtctatggttcatttcaatggctatgactgttgtctgtggagggtagagctacctccagcctcactgcccccagcccatctctgaggctccatcattaacatatccaattgcaaaagtttcctactttctggttcaggacactgccctctgaaaataaagcctccccactaaaatccttttatttgatttctgatttttccctgacatgtgggtcctttattatctgttttttcttttctctgcctccaggcaaggactatatttaagccaattcaaacttcgcaagtcttaaaaataactctccctttgctaaccccttccaggtttggcaggggcttccctggaacaggaaatccatctctttctacctgcccaaccctcatgattaacttgccccatgatcttttcttactttttcaagctattatgctacaatttgacaaggtttttggtggtggtggtaggggagggtgggggtggagtcctgcttttccttccattgccaaggatcctgatttttaatggtgaagattcacttctgtaaaggcaaaacaggcattatggcccctcatgaatattcacaccttgaatgagttcatctttatctaattgttcctaaaagttatcccagccttctagaagtgaaagcaactatgactattttaaaaaacgacctttaaatgtcattgataattatctccagtgtgaattacttccatactgaaaggaggcctctgaagagttttctttttttgtagttctccatgtaatgggcttttgagcacatttgttagttctaatctctcatctcccactgcttcccatctatccctaatgaccagcccttaccctgacatgtttttctgtccccgaaaaccactgcagtaatcaaactcttcatcccctgaaggggcctcctacaaccatgcatctcccttcatgggacccttagtaaagatgagtgggaatctttgatcacagagggatctttggtaaaatcaagtttgctttattaaaaattaagaaaaaaaaataggggctgacaattgggccccatattgaggggagtgtgtcaacttgctgagaaatgaagcgtgcaaaatatttggaaggtaaaatatcagtaaaagaaggataagggtcaaatgatcttccattcccacctcccacccccagatctgcataccctgcacctgaccaccattcatgggtacacatggagacagcattctgggaagtcctcgagtggctcaaccccaagtgctctctactttgaaacagatgcaccaattggccagccctgatatccaaaagaacctattgtgatggcggaaatattctctgtcctattggtacaacagccacttgccaatgtgtgtactgagcacttggcatgtggctagtgtgacagaagaactgaattttgaattgtagttaatttaactttaattcacatttacatttaaatggccacatgtagctagtagctcccaagttggacagcacagaagtggacagaaggaagtggagttgcctgagcaatgtccactcttcctcagctaccagaaaattcctctggatagtggtcacaggagccgattggctccccaaagaggagttccttaccagttttaaatctggaagctgagggaggaaaagacaattgtttggcaaagaaacaaagataaccgaggcttgaaattttcactgaggtgaaacagagccttccttattaacaaacaggcttgggaaaaaacaaagcagagacgtaaaacaaacaaacaaaaaaagaagccctgcctttttttttttaaaccctgcttaggtatgaatcccagaaaactgtgagtgttcaagggctctccttgcctagaaaagaggtggcgtcacagttgtctaattagatgcccaggttctcagactagctgtggtctccctgccttctgtttaccgtctactaagccacaccttacttgggaaggtagaataaggtgggaatgagcattagttaatttcttccttgttggccaggttcatgagagggtctggtggggaggctcatgaaacatcccagacaaggtctggaggatctcagatagccctgggcccagttccacttggcattggtgcattggccgtgtttgtctgagaaagctagttctgttttggaatgatccttagtgatgatcaaccagcagccatcactggatgtctgctgagtaacagactccatgttttctgctatgagattcaaaagaaacatgatgtattagcagagagcataatctatagagttggaaagataaaatatactctcttggaatagatggtagtaaaggtagatattcaagtgttaatttcaggtagttattgaagtaaagaatagggctgtgagggtgtgtatgaatgtgagtgtgtgtgtgtgtgtgtccacgtgcatgcacatttagttaacatgttgggggcagttggtgggacagaacctagagggatgttgggcttcttttaaccttagaaacatcatggctggatggctggtgtcgctactgaagacaggacagtaattggaaatgagtaacactggcactttaagacgggcaaagtacagccagagagaacatggggcagacagagttaaaagcagcaaaccaagatcccaagactgccctgggaccctcgtgcccctactggcctggtcagttccattttactccccttgatggtggtgtcacttcatggtcctcctcagcacatgctgtcggccctgcatctccaccagcagcactgaccagcttggcttggcttcagagtctggtgtgtgccctctattcatactgttggctggcacctccagcagcaggccactgcattcaactgaggtctgggccttgcttctccttcctgcatgctcagggggcaccacccccattccatctgcagtctctggtacatctgcttcacctctctccctggggcaggcagccatgacaaccattggccccaatacccagcagtgtagccaaatgacgcattatttagacaagcatttaacaaacattacatctattctgaaacaaaaatggggtccgtggtatctcagcatccgggagaattttccagttctgacatatcaaaaggacacaggagccagcttgaagaagatcccactgaccaaagctgggacaatttgaacatcaaaataaataatgacaataacaggttataatccatagagtaaaataagaatctgtgggtccacatgtgaatgaatgaatgaacaagatgagaaaatgtcttcctttgagcagaagacatgatggaattagaaaaattaccatttgacaatcatcatcatcataattgtttcaagcaaaaattctaaactaacactaaaactagtggataaatgcttgataaataggatgtttacatagtttcaaactatatccccttaagatacttataaattgtaaaggaaaaagtagtaactttgcagtggaggaacctggccgcctcccctaaccaagtgcttgcagttagcgtcaccagtgaaggcacctgcattctgcctcctgatgaagggcagcacagtgtcctgtcaaaaatgcagagcctgactataattttgagaaatcatcaggcaaacccaaactgaggggcattctacaaaataactggtctgtagtcttccaaaatgtcaagggcatgaaagacaaagcaagatggaggaactgtcccagattaggggagacaaaggagataggatggttaagtgcaatgggggacttttgttgaatcctggaccacaattttttttacttttcttgtaaagacattaatgataatgaataatatgaataaagtctaacatagattagataatagtagtgttatccttgtgaatttccatttttttataatttcacagtgattatgaaatagaatgtcctgttctgagaaaatacactaaaatacttaggtatccttgtgaatttccattttttgataatttcacagtgattatgaaatagaatgtccttgttcttaggaaatacgctaaaatacttaggtatacaggggcacaatacctgtattggggcctcaaaggaactgtccagaatgatggaaatgctctgtgtctttttaaaatttttttttgtagagttgagagtttcactatgttacaaaaactggtctctaacttctgggctcaagcagtcctcccacttcggcctctcaaagtgctgaggttacaagcgtgagccactgcacccgactgaaatgttctgtatcttgactgggatgtgggttacaaggggattcacatttgttaaaactcattaaactgtgctggaaatctaagctttttcccatgtataaattgtgcctcaatgaaaagttaaattaaagcaaattaaattcttaaaaaaaaagataattccaaaatcgctgggtgcaaagccatggaagtggttgtaaatctgtccacagtggctactttgaaattccagagtatccctgatctaagcatattaattgtttttttgatgattcactactttctgctcacacatcatttccttcatagcatttcgcatcatgtggaacataaatgtttgtctgttgtttgataagtgatgtcattgactgtataatacatttcatcttatttgagacctgacagactggaatgacattcgtgttttcagggagaagcagatgacccaggtcagaactttcaggcacccacagcctctatgggaacatttcccaccctaagaaatgttcctgccatctaatgcatgaaagtggcaagcctcatggtcctatggcttgaagccagacagtccgtggattggagtatccatttaatggacaccagctggctccctgccttgttttgaaaaggttggagaatgtatttcttgctttttaaatcatgctcctgtgccaggaagcttctaaacactgtaatccctctgcctccaaatcaggtagagtaaaaatttcctgccaacctatcccagcaggagaaataggaggtttgagcacattgtcaggtctttcaactgaggactagagttcaggccaaggaaacaggttgaagacttcatcatgggagttctcacagtattgtggctctggttgctcaaggaaagaaacacaactctctggttagaccggctctgggctgtcagcagcctggtgggtcccggtggtggttctcatcctttagtgtaatattttgatcctcattggaagatgatgaaatggaggatcagagattttaactcactagaacctgagctttcttttctcttttccagggctcttgcctgtcttggtgtgggtcttcccagaagcagctcctgagcaaggatttgggtgcagtgcatccctctgggaggtgaatgaggacaggagctctgggggcaactgggctgaagtttgtcctccatgggattctggaaagcagtgtagaacaggcacctcagcatttcctccccaataggggagggagcagggtacatataggccaactgggaggtaggggaggatgctaattccaggcacttctgtccatcactcatttcagcaaagagatactaatgtctgtgtgtgagagtggagagggcaggccctgggagggtaaaggcccaggaggtctggggatcaccgagcagtctgctctgccactgtttaggtgtaggccctgtggtgtggaacagctgggagcactgagaaggaaatgagcaaagcattatggacaagaccccaagcctggccttggactaggatcacactgcctgggaaccagtggctgggaatacgcagttagttttctagctagttcctgaaaaagggatttgggtcccccaggttcctaccattggtaataaaccccaccaccccctacatacagggacaaaatccccacactctccatatggcggaaagcttttggctgtccatgttttttagtggtatatttccctaccttttttggggtgggaccccagacccagttctaatctcatatctggaccacctggccatgtgaagctgaggaaagtccttagactccctgtattctgcagcgtacaggtctattcaaacctaccccagagtctgaggaagctgataagctatgtaaaaaggctggcatacggatatggatccatatctcaggtgggtatgccagccttttcttcagcccatcagcttcctcagacttctctgtggaagtcatgtctgtgtctcaggcagcagtgaggcaagatggtaaatccctatgccatcatccccagaccagacccagggcttctatatcatagagaaaaagtatacatgccttggaagggatgtgtaggacaattgcttaagggcaggatttatggtaaggacatgctcttacacaaggaacagtaaataaactggaaaccttagaactgtggttgcttagaagtcaacatggtggattttcatccaagatggagttgctttagcttccatacctttggtccagaattcctcatgtgctatatctgtatttgtttggaatcttctaactcagggaaagaagcagaagttgagggaaggcaggaatgaatataaagagaccataaaggaatcatttcaagacaagtgaagcctcatgaggtacacaagaaagacaggaacatccacagctcactgatgctctcacttagcatctggctcagccacacccactttctgagggtaagggatgctcttgcaggacaaagagcaaattgaaaaacaggagaaaatggttcatgcgggaataaaggctgtgaccttgaccttattagcactatctgggagcaggctcagtgtgtcgttcaattgcttcctatgaaaatggtgaaacagaaaaaggaacaaatcaacaaacagactaaccaaaccttggagaagcttcctatgtgtttactaagaatcaaatcctgctggagtgagaaaactgggattcctttggccaagccctgctggtcaccttagttatgaagagtgatggagcgggaggaaagggtccccagggaaaaacagaaaacacaggaaaatgcccggctttccctccccgagctcagcaccactgagcaaaggacaccggtacaaccagcacatttcatccttctctgtggcggccagaattacagatttaatcaggtggcatcagaaggcaaatatatggacctgtctaatggaaagttcttctgatccacagtttcctgtggtggccccagggctggatgggaccaaaagtgaaatgaattgcacagaaagactcatgcctaacttagttaccaaaagagaaataaagaaagaaagaaattctttagttttgcgatttttttttttggcccatttttattaaggagagatcctggcaatgtcctctgtccaggggcttgcaggtgggatcctgtgcctgtctcactttgtctattcacaccgaagcttttaggtctggtttttgtttgttgctggtgtttagttcctgagagatgatccgatttctgcaacctaaattttccttcagcagaccccaggggaaatcaaggcctctctcggaggcccttccttgtcctgcccaggtccagccccatggtcacctcctctgcaaaggcagagccttggaatggtctgacgtcagggtgggaagttcttatggtcagggagacctggtggaacattcgagaacccttttctctaccttttggaggtcagagctgcccacatgctgcctgagcactcagcaggcagatccttgccatctccatgcctttttcaaggatgtttttgtctgggatgattcctaactcttgagggacactgagcccatggaggatctaattatagtggctatagattttgccactatatatatagatttatatattctgacttagattttgcacatattttgaggacagtctagcccaccctatagattcttagttcctggatcctaagttacggagattttgtccagactgatgtaggtgaggggagaaatttagtggaggaggagcttcagctgctgctatccatcattttcctggagtgggtgggcttctgaatttggaggcatctactaagagcatgacatgtttttaagccaaaacgaaatgaagctgagatcagcggtgggagcagggtgggcagggaggagtgtgtgtctatctacgaaccctagatccctggtaggttaatcacagcttctttcaggttttccttgaatgggttgaataactggatgaaggattccttatccaagtagttgtcacttggccactaatgtccatttttcacagcatcattttgtaacgtagcataggtacttgaatgccaaatgcctttgcttgagatccggtaaagaaagagcctcagatcggggaagcatagaggaatggtttatcctgtggtctaagggcaaagcaaggaatttccatcatgtttcaaaaatgggaaagtttcccagttcctctgcttacctgacccttagatataactcaaatatcaccaccatctcagtgacagggtgggccgtcactcctccacatgctcaagttgccatttctttctggtcttgcatgagtaaccataaccctgttaaaatgacaaatgttttccctgagctgggacaccggtgaagcaggctggatttgtgcccctgaaaattaggcagcctgcccgctaagtgctcagatgagcagaatactgactgttgaatgagcctcccctttgctgctcaattataagacatggggagactaagcctgcacaccttttctatctctcctggagttctgggcactggtgggctcccacccttccctgtgagtttatggtttaacagccctttgtaatatgcactgtcctttcacagcattacctgacttgattctcaccccaagcctgtggggtaggcatgaaggcactcttttctcaatgtgaagctcaggtatgggtcagagaagttaaaggatatgtctgaatcacagctctgatcagcagcagaacatggattcataggctctcatggccctgatcatattcttcacccattcttatcagggcatctgcattcttttgtcaaaggcctctctctggcctcctaagtgtagcttgccagcctttatggtagaccagaagtcagaggaatgaatgctttctggagccacccatagccgatgatgggagttggtgtataaataccccagctcccttaccccttgggcaaggtaacactgagtctgtgtttttatttttcccagagtttctgctagtaggaagccccaggtacacccagggataactgatgcaaccactcatgcctcattggctggtgtctcttcccagtatcacctcctcactccccagctggccctgcttcacctcacagatcaatcacctgtactgaaatccttgcctcagggtttgcttctgggagaacctacactataccccagattcctgggcaccaaatcctggcttttctcatcttctctctgggcgtaaaagttcgccaggctccttagggagaaggcaggctatgtcccgatgctcagaacaccctgtctcaatgctgtggtgcatagagtgtagttaaagttgatggtttttatttctttcttttactctgggagaaagaaaactcactggccctcccttatacactccatcatgaaccgcacggatcagcactgtgtttcttatcataaagagaacttggctgaaatggaggcggggcaggcagagacccaggaggaaaccccagtgtcagagctgctggcctgggaagacagatttgtcccagataggttaaagcgttcatggagtgactgcatttcttctgcacattgccttatgttatgtgagaggaggaagtgccatatcaaactccatgacagatgttgtaaatcttgggaagtgtgctgcggccatctctgcactgtggcttgcaaatgaagccatctgtcaaaccaggggccaggcgcccagccctcactcacctgggctgtgcctctggccaatggctgaggtgacctcccaggcatccatagtggagtatgtttctactttattgaacagccttgaaaatcagagaagctgaggaaaccatgtcaaaatttcctgagaaatttctctcctgcacttggtaaaggtgaactagaatttgccatgtgagtgaggaggacattttttaatgaggcaagagctccacaattcccacagctgctcagaaagttctcttgcgtgtcttgagagagactgaaataaagggaagtcgaggacagcctggctttgttctttgaaactacttatcaaagtaagatcatcctaacccaatatgagaagtatatgtgcaactgtgtgagtgtgtgtttgtgtgtgggggtacacactgaaagaaaataaataaggatgaaggaaagaggaaaacagaactgtttcatggaatacattgtgtaccccaattaatgcttcctatacttttattattttgtttgtaattttatttattattaatgaaactgccaacttgggaataacgttttaggtgctaggcgccacattcaataagaacccaaagagtgaaaggacaaatggagggctatcagtgttcaagatggcttcctgctggttgtcctggtgaagaacagtaacataaagggtaagagaaggattaatggaaactattgaacaaagtgaggcttccgagtcatctccagattgccttgtgcgctgctgtatctgtaccgtagcgtggataatcgtggcaggctatcgttctagccctgctgcgagacagattccaattcattatttcattccccagcatgagccagccaagggaaaaggatattcccagaaccagagtgttccaagttttctgaaaggtcattgccacttttttttttttttggtagctcccagcaaagcagaaacacttggaagtcaaccctgtccctttaacactgctgtgagctgactccatttgtctgagataaaacttccctcttgatccagtagcgttcacggctgagttggccacgagacagaggaccctgtgttcctaattatttctggatgaaaagtcctgcaggcgagtggagattcggggcaaagacggccaggtggagccgtcaccagcgagcagtggattgtagaaatggagagataattaaattaaaagtgccaggtgcaggcattgaaaaataaccctgggtgttaattatgcagttcagtgttagcagaggaaatgccaccggcctgtccatcacgtggcagttgaaaagcttgggaaagacacattcatggtttctagagaatttgccagggctgcctacttgggattctggtgaagcagagattatttattagttggagtgtgtacatttcccccattttccactcagccaagttgggcatttggtgggtacttggtgtgtgggggattaactttgatccacatgaaaatttgaacgttggagtgtgtcacttccaatttaggcacttaggagtatttcttctctttctgatttgaaatgaatttgattttaggggtcagaggtagtgtgtccctgtcatgaagatggaaggataaatggtggcgtgttcagacaatggaatagagcacagtaatcaaaaggaggggaccccagtagcataatagcagcatgactgtgttacaagcacagttgaatgaatgaaagaagccagacctcaagacccattctgcatgaatttattttggtgacgttctagaacaggttaaactaagctatggaggtggatgtcaggtctgtggctgcatcagggaacttttggggtaatggggtaactttcttgggctgaagggcacatgaatgtaaacatttttcaaaatctgttgaatgcacgcttaaaatctgtgcatattcttgcatggaaattatccctcaatgaaaggaatgtgaaaagatcttcccatgttttgtccttccatggattttgaaccctggtcagtcagttcatttcaaaaggtgataaggattaatctgtttgtggtccttcctgaccacccagccttttcctgttcacagacctgttcagaaaaggctttcattccaaggaagcagaatggaaaacagggtggcccactacagcctttgggccaaatctgctcaatcacatttttgtaagtaaagttgtattgggacacagccacatggccagtcatttatgtgtcttctgtggctgctttcatgccacagtgacagccgaggagcttttacagagactgatccaccacctaaagtgtttactctctatccctttacagaaaaggtttcctggcccttggtctaaacattcatttctttttggaacttctcccttcagatctgtgtgggtggaggttttggatggagagtgctctccaggaacgagaaccctgtagagccaggtacttaggttgagcatggtcacaatttggataagctatccttcatcccatggagttcactgggcatgcgtgctgtcacagatctacaacagtgcacagagcttggcctacgtagaggtttttttaaaaaaaaaaaataaagttatccaggccactgtaaagagaagaggaataaataaggcctggaagccatcagtggacaaagctagactcctgttttaaactccaagctactggctataaattagtcctgcatggaaaataaaactaagctaactgattttgataaaagtaaatgtgatctggttgaattgggtccacatggttggcaatgtttgttaagtcaatgaaggaacaaattgaactgatgtaacaattcagttttgaatttggggctaaatgagccattctgttgaagacaccctgtgctgctgttttcttcagtaagatttaagcctcccttctttcctttaccttccacccaagatgaatgcacgtgatcaagcaggaagtctctggaggatttgctaacgagacacacaggtccccaaagctcagtctttcttcattttgcaagtatgtatttccttcatctgtctgttttctcattccacagttactggaattaaagagttagatcttggggaaaagcaatcaatagcttttttaatgaaaggggacaaatgcaattggtatcacctaaggcttgagaagtagatctctactttctttaaaaaaagctcaaaaaaaaaaaaaaggatgcagtgggggtaattatagaccccaagagtccacctaactggggagttttaaaaagtcaagggaatgtcttgtattatattggactgttccttaatgactccaggttacagtggctgtgagcagatgaggaataattgttagaaatggaaaattaccatttaaccaagaggatttccaaaacaagcagatgaaccatgagcggtaaaaatgtgctctacggaatgtgattattgctgatttcatcatatgtcctgggcatcttgggtgagaattcactcatttactccgtcacatatgttcagagcctcccctaagtctggcactgtactaggagctgggggcacccttttgagaaccacccatgtgtttctgccttcagggatcttcactctggagtggggtggtagaggtggagaataattggagataaggctggaaggccaagatgccagccacgtgggatcagggttttgctgagttttttatttaagcctgtggtcagtggggtgccattttttttactgttttaggaatgagggggtttgataagcccgagtctcaccagatttgtagtgaatctgagctggatcatgttgttatttgtgctgccagtgatcctggggaaggactgtccatgggccatggtgacctgtgctcacaggtgcacacccccagttacctttgtaaccagaaattagtcaggggttggcagaattaagccagtggctgcttccactgcataatagtataaaaaatgattaaatctctatacaagcctcccctcctccctccaggccactgtatcttacaacaacaacaatgacaaacaccacaccattatctgattttcccccttctagcttgtttcatctatggatttgggattgaaggagaatatgattgtccatattttcatcaaatgtaaagtatttgttctatacgtattcttatagaattgctaaaataaacctatgacccagacataggctggctagcattgtctatgcattcattcatttagtaactcatatatatgaagcacattgctgtatggcaaataccctacttggtgcttgggaataaacagtgaacaaaagtgaacccagttcctgcctacagggaacttacaataatggaggcaggtaataatcaaataatattcaaatttatgcttgcaagtttagaaaaggtttgtaagtgatgcaatatgatgagatggcacaacaggtctaggggtcaggagaggttttgcagagaagaaagtgacactgggtctggaatctacaggaagcgtattgaccaggtgaaggttgcgggaaggcctgttggtgcaaagaagcagggcacattagaggaattgaaagaagactgcagagaatcagaaaaggagagtgcggtgtgagacagggctggagacactggcagagacccggcaatactagtccttgtgggttgtgctaaggaggccgggcctgatttcaagaacagcaggaggctgctgcagtgctttaataagggtggatttacatttggaagatgcacatttggatttacattttggaaaggtctctctggctgctgagctgctgtggactggaagggggaagattcaacctccgatgatggctttctgctgatttgttttccttctttcacttttcttctgggtttgggggctcttggctgatttagtctctactagcctctgaggaaaagcactggtcctggggtatttattaaaggaagcatgatggattattttggagggatattctttgaaatctggagtgagagggggtaccatatgccagcagcaatgggcaaaatggtgctaagaggtaaactgatgtccaaaatgattccatccaccaaccttggacatgagagtgaagttcctatttcataaatggaaatataaacctagtttatcctttgacatccagaataatgtgtaagaagttttccttggcagcaaatcttaaatgatggagccttggggaatgacttctgaccctttataataattagccaggccaggacacataggtaagacacctggtgaccaacagcctaagggtcagggggcaaagggtggtaggacaatataagagtgcttaactcagtgtcctgcatagatggtagctattagcataatgactatcactaatatacacaccactattaccaacagaagtgtcctatattgctctctcatcttttaaaatatttattcatttattcattcaattcattgtttcagtgaatgtttattgaacacccacaatactatgcattgttatgggaggtggggactcaacagtgtcaaaaactaagttccagccaccatggagcttacattctggttgggagaggagaataaacaaataaaattaaataaaggaatgcattgtctggcagacggtaataagagctgagaagagaaacacaaagcaggataaagagatggagaatgatggataagatgatctgggaggccctctttgaagaggcactgtgagccaagctctgaatagagggattgaactatgcagatgactggaaagatggaacagcaggtgcaaaggccccacagcagaagacgcttgcaggatttgagaaggggtgccctccactgtgtgcccagagcttctgttattctataactactaaccttagtaacaggagtgacccctcttccaggagaaggagatgagcagctctgatagagtagcatccgctttcaattttctttctttatttcttaaggctcttattccaacctcccaactacggtttcagcacaagttaggtgagcagctatttatgtactaggtgaaggttcccagaataaatgtcttgagattttaagcaaggtgtagtattatcgtatgtctcttctgacaattttccaggttgacaaaaatctgcgtttgtctagcaacatggtgactggaggggcaggcaggcattctgttcagcatggaacagaaataagcagtgggagctgatgtgctgaagtagcaactgaaggaaatacagctttggataaaatggagccactcaaatggcatttgaaatgtctgctctgaattcgacagatgatgttctctgccaccggcatcctttccgatatttaatgcagacgtttgccacgtgtcagttctcagctggggactaggaagcattcttcagggtgtcagcgtcttgataaacatgtcaccaatttgtatgattcactacacatgaataaatgctaggaatttggctgatcaattcatatgccagggcctacaaatgtggaggaaaatcgcacttcttatctgtgggcggaaatgcaaaaaccagcgtgatagtgcacaatgcatgatctgagtgtgtgaaaagttttagagactcgattactgttgatgatgatgatctgagtaattgaagctgtatcagaattagtctaatttactgcagtgggaggaagaaaaaaaaatatttatttttatactcatgagaatcatagtgattgaaattaagcaatttcctcatctttttaaaagacaacctagagacgctgttatctttgttccaggggccttgcggctggcagacatgcaatgtgaatttacttgtccttcctgatttgggagctgctcaagccctgggtgtaacgagcatctgtctctctgcttggctcctgtctctctggctgtgccaggcaacaccaaaacccccagagggcattaagactggataaccaaactgcacaaatgtgagagaagagaacaaggtttaattacagcttcccttcattgcctgtcttctcccaccccaaaattaatttgtaaacaaacatggcatattggggtttgaagaggattcaagcaggaggttgtttggttgtagccaggatagatgatggggctgcagtgtgctccgatatattcactcaagtctggccgccccatgtctctacggcaaagcctgcaaaattgtgagcattcaactctgtacaattacccctgactcagctgccaaaacgtattttccatccatttttgacagaggcttctgtttaagtagagagaagaggagagatgatctcttttaaaagtgattccagtctgattctcgaagtgcaagtggtaaagtcaccaagcctaattggaatgaattgatttatcctctttggcagccctgatcagtaccctctcaagagactggactacatatgggaggtaatcatgatgatatacatatttctttggatgctgcttggctcatccagtccattttccatagatattatcacttaagacagctgctattctatcactggtcttggattttttatttaatcccgtacttcaaaaagagaaatctgttggctttttgaatgcagaagaattgccagaaaagataggggagacaaactgtttcctttaacagtcttctatggaagttaagttttttttttcccactacccccaggcaaaaaccgaatgaccatttatcctgtgaaatgtcctgaagctacatgtagtatacacatagtaatcatctgtgtactcctgcctatgttctgtgttcatccatcagacccatcaagccttgagttgtccttctgcctgtcgtgcttgaccctgagaggactgaggaatgtggggttgggggctcagcctcttaattgccatggtgtgtgatttatctgttccacttttgtcttggtcagttggggctgctataacaaaatgccatagactgggtggcttataaacaacagaaatttctttctcacagttctggagtctgagatcaaggtgctggagattcagttccccatgaggcttgcagacaggcttcttctgactgagtccccagatgggagaggcaagggagactgtcttctgtctccgcttataaaggcactgattccatcatgagcatgccaccctcttaacctaattacctcccaaacgcccatctcctaacaccatcaccttggggattagcgattcaattgtgaatttggggaggacacaaacattcagtccatagcagcttttatttttatcttttgctattctttttattttggaataactttatttctctagctttatcaaggcataattggcaaacaaaattatatatgtttaaggtgtacaatatgatgtattcactttcataaacattgtgaaataattaccacagttaagataatttaagatattcactgcctcacatagttagcatttttgtttcatgttaataatatttaacagctactctcttatcaaatttcaattatacaatacagtattattaactatagtcatcatgctatacgttaaatctccagaacttattcatcctgcgtaactgaaactttgtgctctctgaacaacatctcaacatctcctttgcctcctagctcctggtaaccaccattctacttgctgcttccaggagcttgacttttttagattccacatataagtcatatcatttgggtttgtctttctgagcttggcttatttcacttagcataatgcccagtaggttcacccatgttttagcaaacaaagaatttccttcttttttaaggctgaatagtattccattgtgtatatataccaccttttctttacctattcatctgtaggtagatggacacttaggttgattcagaatcttggctattgtgaatactgctgcaatgaacatgggagtgcagatatctcttcaacatactgatttcatttcctttggatacataccccaaaatgggatgtgagaatcataaagcagttctcattttaattctctgaagaatcatcatactcttttccataatggtggtactaattatatcgccaccaaaagtgtagaagagtttctttttctccacatccttgccaacacttgttttcttttgtctttttgtgaataatcatcctaataggtgtgaggtactatctcttagtttgcgtttctctgatgattagacatttttcttgtatacctgctggccatttttatcaggacccttgatcattttttaatcaggttatttgttttcttgctgtgaaattgtttgagttccttatccattctagatattaatgccttatcagatgtatggcttgcaaatattttttctcatttcttaggttgcctcttcactctgttgattgtttcctttactgggcagaagggttttagttatgatgcaatcccatttgtctgtatttactattgttgcctataattttggggtcatacccaaaaaaccaaaatcattgtccagacctatgtcaagaagctttcactctatattttcttctagtagttttaaaacagtttcagcccttatggtaagtttttaattaatttagaattgatttttgtatatggtgtgagataatggtccaatttcattattaagcatgtttccctaatgccatttattgaagagactgttctttccccgttgtgtgttcttggtactttgttgaagatcaatcaactgtaaatgcatgaattaatttctgggctttttgttctgttccattgacctgtgtgtctgtttttatgccagtgccttgctcttttgcttattggagctttgaagtcaggtggcgtgatgcctccagctttgttctttttgctcaagattgctttggctattcaaagtccttgtggtttcatatgaattttaaaattggcttttttttttttttctgagacagggtctcactatgtcacccaggttggattgcagtgttgcagtcatagctcattgcagcctcaacctcctgggctcaaatgatcctcttacctcagccttgcaagtagctgggactagaggcacacaccaccatgccaggatcttatttttgtagagacaaagtctcaaactgtgttgcccaggctggtctcaaactcctgagctcaagcagtcctcctacttcagccttccaaactgttgggattacaggcatgagccaccacctggcctatttttctatttctgtgaaaaataccattggaattttgatagggattacattgaatctgtagatcactttggctagcatggacattttaacagtattcattcttccaatgcatgaacacaggatatctttccatttatgtgtgtatttttcatttttttcagcagtgcttcatactttctagtgtgtggactttttctctcttaggttaaatttattcgaagtattttggtttggtgctactgtaaatattataagattgttttcttggtttctttctcagatagtttgttgttaatggacagaaactgctgattttttgtatgttgattttgtattctgaaactttactgaatttatttatcagttctaacagggttttttggtgtagtgtttagagttttctgtatctaaaatcatggcatctgcaaacagagacaatttaacttcttctttttcaatttgtatgcctttttatttcttatctggttgctctagctagaactcccagtactatattgagtagaagtggtgagagtgggcatccttgccttgtaatagctcttagagtataagctttccatttttcccattgattgtgaggttagctgtgggtttctcataagtgatctttgttatgttgaggaaattttgctctatacctaattttctgggagtttttattatgaaaggatgccagactttgtcaaatgctttttggcatctattgagatgatcatgtggtttttatttttcattctattaacgtgatttgtcatgttaattgatttgcatttggttaaccaaacttgtatagcagagataaatcccacttggtcatattacataatctttttgatgtgttgttggatttagcttgatagtattttattgaggatttttgcatctatgctcatcagatatattggcctgtagtattctttcttgtgatgtctttgcctttggaggaatttaaggaggattggtattcattcttctttaaatgtttgttaaagttcacccatgaagctacctggatctgggcttttctttattgggaattttttgattactgattcaatctccttactcgttattggtctgttgagattttctatttcttcataatttagtgttgttagattgtatgtttctaggaatttatccatttattctaggttatccaatttgttgttacataattgttcactgtagtctcttatgatccttagtatttctgtagaatctattgtaatgtttcctcttttatttataattttgtttatttgaatcttctttcttttttctttagttatgatttgtcaattttatttatctttttgaaaaaccagctttttgttttatgtatctttttattgcttttttctctatttcatttatttctgctctgattttacttttcctttcttctgctgactttgggcttcattctttttttctaattccctgatgtgtaaagttagtctatttgagatctttctttctgcttatgtaggcatttatcactataaacatccctcttaaaactgcttttactgcatcacataatttttggtatgttgtgtttccaacttcatttgtctcaagatattttttaattttctttttgatttcttctttgagcaattggttgttcagaagtgtgctgtttaattccacatatttgtgaattttccattttttcctgtttttgaatttctggtttcataccattgtggttggaaaagacacttgatatgatttcagtcttcttgaatttgttaagacttgttttgtggcctaacatgatctatcccgggaaacatttcttgtgtgcttgaaaagaatgtgtattctgctgctgttggatggaatgttctgtatatgtctggtagggccatttggtttatagtattatttaagtctgctgtttcattattgattttcagtctggataatctatcctttgttgaaagtagagtattgaagtcctctactattattgtttttaatttttttaatttttaatttttgtgtgttcatagtggtatatatatctatggggtacaagagatgttttgatacaggtatgcaatgcataataatctcatcatggagaatggggtatccatcccctcaagcttttatcctttgtattactcttaatctaattacgctgttagttattttaaaatgtacaattaagttattattgactgtagtcaccctgttgtactataaaatagtaggtcttctttattttttctaactatccctactattgtattgctttctatttctccatttacttctgttaatatttgcttcatatatttaggtgttctggtgttggatgtaaatgtatttaaaattgctgtatcttcttcatgtcttcatgaatttaccccctttatcattatataatgaccttttttgtctcttgtgacagtttttaacttaaattctattttgtctgatataagtatagctatcctcagcctggtgcggtggctcacgcctgtaatcccagcactttgggaggccaaggcaggtggatcaccgggtcaggagatgaagaccatcctggctaacacggtgaaaccccatctctactagaaatacaaaaaattagccgggcgtggtggtgggtgcctgtagtcccagctactcgggaagctgagggcaggagaatggtgtgaacccgggagatggagcttgcagtgagccgagattgggccactgtaaataaatatagctatcctctcttgcttgtttttagttcctatttgcatggaatttctttttccatcttttcactttcagcctatgcgtgttcttaaaactaaagtgaatcttttgtagttagcatatggtcagctcttgtttttttaatccattcagtcttttaattggataatttcagccatttatatctaaagtactatcattttaaaattgttttgtggctcttttgccgttcctttattcaattcttccaatcttgctgtcttcctttgtgatttgattatttttgtagtgatgcgctttgattcttttctctttatcttttgtgatttatctttattgttaccatgaagcttacataaaacatcttatagttattgcagtatattttaatctgataacagcttaccattcattacatacaaaaactctccattttaacttctcttccccccaaactttgtgttattaatgtcataatttatatcttttatatatccttattaaattattgtatatatagttatttttaatacttttgtcttttaactgttacactggaactaaaagtgatttatacaccactagtacaatattagaatactctcaatttgactatattcttacctttaaattgagttttatacttttacatgctttcatgttagtattcttttgtttctacttgaagaactccctttagtatttcttataatacaaatctagtgatgattaactctcataccttttgtctgtcagggaaagtccttatctctccttaatttctgaaggacagtcttgcaggttataatattcttggttagcagggttttgttttttttttcttcttcaatactttgaatatatcactgtactctttcctgacctccaaagtttctggtgagaaatcttctgatagtctaacagacattcccttgtgagtggcaatttgcttttctcttactgctttcaaaattattactttttgtctttgacttttgagaattgtattataattgtgtctcaatgaagatctctttatctttaatatatttggggctctttggaatttatatatctgaatattaacttccctttccagatttggaagatttcctgtcattatttgtttaatatgcttttagcctcttgctctttctgtgttccttccagaactttcttattggtatgcttgattgtgttccataaatcccatatcctttcttcactctttaaatttttggtggtgttgttgttgttctgactgggtaatctcaaatgacctttctttaagctcgatgattctttcttctgtttgattgagtttgttgtgaaaaaactttcagttcagtcattgtgttctttagctccagaatttttgttgtttcctttttatggtttctagctctttgttgaacttaccattttggttttttgtttcctgatttttatttagttgtctgttatctcttgcagctcactgagtttctttaagattattattttgaattctttggccaggcagtttataaatttctatattttgaggtcagctaatgtttttcatttcgtttctttgttggtgtcatgtttccctgattatttgtgatccttgtggccatgtgttggtatctgcccatttggaaaagcccttcaccagtcagctgatccagagatgctcaatggaccatctggtgtggtccatgggtgggcttgccactaaagtccttggtaggcttgcctggtgcctcattcatcagttcaccaggcctggtgcctgggtccacaggggctggcttggaggctaggtccatgtgtctggcctgtagtataggaccatgaagaatggcctggcactggggcaggcctggaggctgggtccacagaggtctacccagtgtgatgatctacagggcagaattaaatgctgagtttgctggaccatggagctgtggggagtgacctgttgcttggagtcacagggactggctggacctggagcctacatttgctgaatttcctgtatcagctataattgctgaatttccaacatgggaatttccagcataggcctggcagggaggctgcatctacaggtattggcctggtgcctgaggccaaagggactgacactgagcctggggaggcctggagactgggtctgcaggtgcagatttgtagctcggggctgcagaggccagccttgcactaggtggtcctgaattctgaggctgcaggggcttgcctggaagtgtagcaggtctgagggctgagactttgggagccagactatagccttgggctctggaggctggcctggcaccagtgtgggcttaaagcccagggttgcaaagccaccctggtgctagggcaggtctgagatcagcggctttgggaccatcctgggaccagaacatcttgtcatcactgctcacgtggcatttaacccaagctgtcttgttctggtgtttaacagattcaaggaagcctttttatccctaaccccactaacacccttggctccttaggttaggcctcatgagaattctctttttttatttcccaaggctactagccaagctctgggccatagtgaaccaccagtagtgtcttgatgacttcttgatgactgagtaactatgggtgaatgaatgtatctcatagtccctgagtgtgagtctagatgtgtgttactgaggaatgtagaggagtttctggtctgagggtaggcttttcagatctccaaggtgaagcatcctgtagctcagtttttcttgagggcacaaatacaaaatctaaaccagtggatctcagactggtgtcccatatccagcaggccacatcacttaggaacttgggaatgcaaattctcagggcccatctagacttcctgaatcagaacctctggggtgaggccatgcagtgtatgctataactagcctccagggaatttggaggcactctcaagtgcaagaaccactggcccagaacactgcatttttagctatgctgccagagggagcatagtctttgggagtcttcagtctttgggacgggccttggctgaccccaagagagtttacacagcctctatgtctggaaaagtctcacagaaaaatgcagaggtttttccttagctaagaagactgactcctctggcctcttgaggcttgtgtctataaagagacattctggagacttggcttctgtccctgctacattgactttttgtcagcaggcaggtagcaagcagtgtctccgaatcttgtgcctggagaagggaacaaatgttctgggtacagatgacccttcgcttattgtccatcttcctttcagaaatctaacttcatgagaccagtgatagagtcctgctgtttgcctaggtgtcgggggcacacagtaggtatacaattaatgtttgttgatttaaaaaaagaaaggtccttggagcatagatgtttagaggtcaggtgaggaattaagatttatatcttaacagtttcctgagcctgagttgtaattctaaggggtaaacaaacaacagttacatctgaaggtcccttgtattgggccctctgatcacctgtgggtacaggtgggcagaagggtggtcacggagggacataattcattcaaatgccttagtctgcctcaaatgcctcaaagcacatggattccagcatgttctattagcgtttcttgagagtggaggatataggaaccttctcagtgtttaaagttttagagaagacttatggagtgatgagaaatgttccagcatagctcccagggctgggcctggatacttctagcttggctgtgagctttgctgtggcttcttcagctgtttgtgggagagtgctgaccaagcaagatttctctcaataagaactagaaccaaatacaaaactgaggatgtgccctggctcccatggtaatgatattgtaagattattttatgtgccgttgagattgatgatctcctgtttgccaggcaatggtcctcctgttaccctagctggatgacagcattaagccagagtgaaagtgtatcaaccattgacctgtaacatacagatctgtcatgcatcttcatttcagatgacaaatgtgagtatgacatgtgggtaaatctttaccagagaatagaccaccacaaaggcaggtgatcatatgtttagtttgctgacagtaattgagtgagcctttcccttcttgcaaggaaaggagaacttgcagtcaaaaggggaaagatcctctcttatcttgtccatctttatggccagaacaaaaatatacctcacttcctgtctatctcttatctctgatcacacctggttatcctcaagcagagagtacatttttcagtgaagtagttcaatcatgatctggccaacaaattattgtttgttaaataacttttaatctgattattaaaaatatgcataatctcttacagaaaacttatgaaatatagaaatatacacagaaaacataaaaatcactgatacccatagcctgacatcattctttatgatgaaagactgaaagcgtttttcctaagatcaggatggccattcagggtactcgagggtatgatagagactgtggaagaaacaaagcacactcacaccaaccactagaaatgaggatgcctgcttttgctggtttgctcaacataccactggaaatcctaatcagagcaattaggcaagaaaaataaataaaaggtattggaaaggaagtagtaaaattatatctgtcataggcaacatgatcttatatgtagaaaacaaactgttgttactaataaagaaatttagcccagttgctgcatacaggatcaacatacaaaaatcagttgcatttctataaaataacaatgaataagctgaaaatgaaaccaagaaaacaattttatttataacattatcaaaaagaataaaatacttaggaataaacttaaccaaggaggaaggcaagagatttgtccattcaaaactacaaaatgttgatgaaagaaattttttaaaaatgtaaatagatgaaaagacatcacatatttatgtaattggaatagttaatattgttaagatgtcaagattacacaaaatgatctacgtatttaatataatacccatcaaaattgtaatagtgttttttgaagaattagaaaaatccaccctaaaattcatatagaatcttaagggaccccaaatagccaaaacaatcttgaaaaagaatgaagttggaagtctcacacttactgattacaaaatatattacaaagctacagtgatcaaaacagtgtagtacttgtgtaaagacagacatagatcaatggaatagaataggtagcccatatattaaccctcacatatgtggtcaaattattttcaacaagagttccaagactattcaatggggaaaggacagtctcttcaacaaatgtttctgggtaaacttgatatctacatgcaaaaggatgaagttgagctcttaccttacaccatagacaaaaattaagtcaaaatgaatcaaagacctaaatataatatctaaaaatataaaattcttagaagaaaacataggagtaaagcttcctgctgttggattttgcagggatttctcagatatgacaccaaaaccataggcaacaaaagtagaaatatctaaattggactgcatccaaatgaaaaactttcaccaattaaaaaacactatcaacacaatgaaaaggcaacctacagagtgggagaaaatacttgcaaattatatatctgatcataagttaatatccaggatatataaggaagtcctacatctaaaagcaaatgagaaaacccaaataacccaaaaaactcaataaaggacttgaatagacattccttcaaaaaagatgtacaagtggccgacaagtgtatgaaaaaatgctccatgtcaccagtcactagggaaatgcagatcaaaactgcaatgagatatcacctcctacctagtaggatggctgtcataaaaaacaaacaaaacagaaaataacaactgttgataagtctgtggagaaattggaacctttgtgtactcttggagggaatgtaaaatggtgcagccacagtggaaaacagtatggtaattcctcaaaaaattaaaagtagaattgccatatgatccagcaattccacttctaggtatatgcctgaaggattgaaagcagacactcaaacagatatctgtacccacatgttcacagcagcattatttacagcagtcaaaatgtgggagcaacccaaatgtctaatgattgatgaatagataaacaaaatgtggcgtatacatacagcattatttaaccttaaaaaggaagacaattctggcacaagttacaatatggatgaaataagtcagttataaaaagacaaatactatatggtgtaacttatgtgtggcatcaggtacaggccgactcacagaaacaggaagttggatggtggttgccaggtactggggggagaaataaggggagctaccgtgtaatggtcatagagtttcaggtttgcaagatgaaaaagttctggggacaggttgcacaaaaatgtgcgtatacttaacactacagactgtacacttagaattggttaaaatggtaaattttatgtcatatgcattttatcacaattttaaaaagtcacttatgatccacatgatctcaacatcagaactgaccaatgttaacattttggtatataactctgtctagtttgtagatttttctttcctaggtgtatgtgtttgcaaatgtgtgtgtgcatacacacataccaacacaaaatttgctctgttcgtctgacagttctgtaggcatgtagagaactacaaattagacaagatagttcctgctcacatgagcagagagatactcaaataatgacaatgaaatctagctgtgctctagtaactaaacgctgaaaatgtcagaacactgcgggagccagagggggatgacctgcaaagaaggaggcatccaagttgagttttaaagtatgagtaggaattttatagcagaaagaggggatcatagcattccaggaaggagaatagcatgtgaaaaggcatggggttgtaaaaggttgtgtgtacttggggaataatgaagagttcatgcctgtgtttcgagaattggagtggggtaggtagtggcaggtcacgagcctagaggagatggtttggggccatttggggctttggtcttctagctgtgagccaacaggacccacaccctccaaaccctgagatggttggtttgattgattttaataacaagaatgatattttggctgcaacatgacacaacaatgattactaggaattacttgtcattgtagaatttgtatgataacccttgaaaagatgaccatttatggctctgcaaaaggaagttaccaatatcctcgttaccagatgtttaaatttctaatgggtatacaagttagctcgcaaaggttgatgtgctcttgctgttgcctttccaattggtgcactttgaaatagaccaagcaatgagtatacaaggtttattaatctttactgtttacaataacaataaagcaagacataataaacttttaaattttctaatagctacattaaataaagtaaaaatgaacaggtaaacttgacttgaataatttattttacccattttagtattgagatagtatcatcaacatgaagtcaatatacaaattagtaatgagctatttaaattctctttttatagtaattcttcaaaatctgatgtatattttacacttatagcacatatcaattcagactgttcacattttgaatgctcaatagccacgttgtcagtggctatcctattgaatacagcaggtctagaacatgcagtggtttaaacccaataaataatagccacacattgttcacagcctttggttggaatgaaacatgatcagtatcagcactgttttaagactttgctcatagtgcagatcaaattacttctctggcatttaggaaggtttaagctgatggagtataattttcactgacactttcatttgccaggatcatatagtgtctaaaaaatatgcagtcatgtcaaatcacggtaattagtgccagaaaaaaaaatgtgtcaaagcatgcatgcagactctaacatctccacttgccaacctcatgtgtgaatgttcttttgcattttcatctcagtcaacagaactgaattctgcttcaggatatgtacccacggcctgtgttagtataggtggaattgaatttagaacagaacttggcctgaagggtaaatgagaaagtgatctttaacactgctaaatattggaggtagcaaacacataagcatacactagacactttgataaatgtgtttgtatatgcgtttgcatttcaaccccactcaatagaattcattctttcagtctcaatgtaaacatatcatacccacttttcaaattttccctcattccatgtcttacatgtttttaagatacagatttgaaactcttaaatcatacattatctttttctcattagcaaaatttcttccacaatccatattttttctcctctcaagatacacgcaatttgttgtacatcataaccagttaggttcttgccaaaggtatgaaataatttttttgagatggcgttatcttgacgccaagccctccaatcaagataagaaactagttggaaaccccaacagttggaaagaaaacaagacttgagcccaggagttgagcagtgttttcaaactttgaaggaaaacaaaatcctaaaaacaacttattatggataacagacatttgttgtcttcaaaagcagaaatggtttttccatatctcttatttcattttgccttaaaaatgttagcttttttcaaaatgtggttataaaggaaaaggttgtgctttttttttcttttcttttttttttttttttttttgagtggtaattaaacagataaagaaaacaaggtaaagattctaaagtttgaggctgttaaaatagccagactctgcatctattaaataagttggaagcttccaagaaataacataatttggaactattgttatgatgttgaaagggctgttgtgtgagagtctgaaggaggaggagctctagggcaacaggaaatgagattcaagtaggaagtgagaggctcacagagaatgagaaagctgactattcgtctgccacttgagcaaggaagaggccctgtggagaaaatcaacaccattttcttaaaacatgctcaagaggaataataacctaccttattagattatggatgttttctacttcttttttctatcttggcttctttctcttaaattattactttttacttatctcaggaattaaagccttctctcttctattggtaatcatttccttttgacttatgattttacttgtgtgacttcccattgatatacctttattacttaacttaaaggctctgtaacttttttcttcttctttaaaaaagactgttgggattttgattgggattgtgttgaatctatagatcaaactggggagaattgatatcttagtaataatgagtcttccaacacatgaatatggtatattgctccatttacttcagtgttcaatttctctcagcaatgttttgtaattttcattttacagatctgacacatcttttgtcagatttatcccatttttgacgttaaaaagtgtgttgctttttaaatttttgatattttgttttcatttcaacttttaattattcattgttagcatttaaaaatgtgatagatttttgcattttgattttgtatcttgcaaccttgtgaaactcacatatatgttctaataccttttagtctacaacattaaattttccacatagagggttataacatctgcaaatgaagacagttttcttttgtctttccaatgtaaagaaagacattttatttatttttcttgtcttattgcactggctagaacttctgtaattttgaacagaagtgaggagagtagctatccttgttttgccccatatctgggaaatgcatttaatctttcactattagattaattattctgttttagtcttcagaataattctgtcttcataaaataagttacatgggagctagacaagttttgtgtgcaattggtattatttattttttagttggtagaacttaccagtgaagccatctgggcctagagttttagttctatttgcattaacgtttttagatataaattcgatttctttagtagatgagggctattcaaattatctatttctttggtagtttgttcagaaatgtgttcatttcatccatgttgtcaaatttattgacataaggttgttgaaatatctacttagtgtccattacatatatatagaatctgtgttgatgtcacctccctcattcctgatctgtctgaatagttatcatttttttatgaccatctcaagaatcagcttttggtttcattgattttcttaattgttttctttgtttgtttattttgtatttcgttgatcccactctgatctttattattttctatcttctacttcctttgagttttatttgctcttcttttcttagtttcttaggttggaagctgagatcactgatttgaaacctttcttctttttcaatatagataagttctatatatttccccttacttgatgacatctggcaatgtttgatatggtatgtttttattttcatccatttcaaaaatatttctaatttctcttagaattcttctttgacaaattgattatttagaaatatattatttgtttccaaatattttggagatttttcaattatccctttgtgactgatttctagtataattccactatggacagggaacaaactttgtatgacctgaatccttttaagttattataatcgaggctaattttatggcccagaatatggtttgttttgacagctgttctgtgtgcacctgaagagaacatgctttctgctgttgttggatggagtgttttgtaactgtcaatttggtcaagttggttggtagagctgttgaaatctactatctacttactagctttctgtctacttgttatattagggattgagaggaagtgttgaagtatctttttgttctctcttattttggatagtttctattggtatatcttcgatgtcactaatcttttattagacgaaacatctaatctgctgttaatcttgtccagcatatttttctcagatagtgtggttttcacttagagatgctcaattaaatttttttatatcttccatgtctctacgtaacttttggaacatagaacagatagttataacaacttttctaatgtcgtggctctaattctatcatctgtgtccattcttggttagctttgattgattgatttatctcctcattatgggtcctgtttttctactcctttgtacagttggtcatttttgattggatatacagacattgtggattttaccttattaggtgctggatatgtttgtattcttataaatattcctgagttttgttctgagattcagttaggttacttggacacagtttgattcttttggatcttacttttttgacttgttgggcagaatcacagcaatgctcactggggctaattattacccacttctgaggcaagaccttcccatgtactctacccactgccccaggaatctttccattttccagtcttgctgttgagaacaggcactattcctagccctgtgtgagtgccgggcgctgtgacctctaacctcttcgagtggttctttcccaggtaggctcttcatctgtatgtgctgatcagtgctcagctgaatgctcctgcgggaccctctgcaaccctctagaattctgtgtctgatcagctgtcttctccctagtgcccttccctgaggactctagctgtcttggtctccttagactctcaactgcatctccccagttcaagaatcctgccagtctgcttctgtgtttccctccccatgctgcagcatcttggaatctctctcaaagcagtaagcagagggatttctagggctcatgccattcatttctcatcttttggggatcactgcccttttgtgcctgatatctattgtcttgaaaactgttttatatattttgcttatttatttatttttggttgtttaatgtaggagggtaaatccattccattactccatcttgatcagaagcttgatctggggcaaatatttaaatcccagttcctctattttctcaattttcacccatgtttcataaggctgttatcgagtgtgtgagttgctcaacgtaaagtgcttagagcatgcctggcatttggtaagctcccctccatttcaggagggaaaatgactgaggtccaaaagagacaatggtcccaattgctcttcctgagattgtcaaaagaatcatgagacagttcctagaatgaatgctaggcaaacctctgaggtcagacagtggctgaagcacgagtccacagaagtgggatggtgctgccaatgatgacaccagcctctctcatctctcacgggtagtcttggagagtaagaacagctcatgcagcaaactgccatgagtgacagaggaaccgatgaaagatttctagatggaaacgattgttgcatctgatagtctactgtcagtcttggggataagaggcatccactcagatatgtattggaaagtagttcagagcctcaaataatcaacaaatgtttccagaactttggggatcatctactttggccccattattgggctgatgagaatactgaacaaggaaaggttaattgacttgttccaaaggatttcccaatagggactgattaggaacctgattggagagtggagcagctgctgtcaggaccctgcctggaggtcctcacccttaccacatcaagttctgacttcacttctttgtccaagggctttctttgactcacaaagcatgttttgcctgtcgagtagaagcatgaaagtgtagagaaataatgcccttgtccaagaatccctctcaaatgatgactgcgggaattggtgtgtaagtaccccagcttccttcctcaggagcacatgctttacactgcttcctggaattcactcgtgggattgagctccagttgtctacagtggtagctggtttgataacacacgttttattgatcaccttcacttcactgtctcatttctctacctcctactggtgtttcttgggctcacatccccaaaatcattgcttgcccttaaatccttgtcttgttgtctgcttctggggagaacccaaaataaggcaggggctacatggggacaatttacaagtttcaggaaaggaagaaacaacaaaggcagaaatccctttttaatgtaatgttatgaaagaggaaagaaagaattactgctctgaagctctaatctaaagattagacagaagcctgggaggaaatgatcacaaaataatcaaatccttgatgatctcaataggaataagccagaaaatgaagagagttcagtttacgaaagcagatttgcttagattttctctccagcctttttcccctaacgattacaggaatgtgagtgaaggatgaatggagatattagaactattatttagcagcctaaagtttgcttcagaaacaaacaaaccagggtctcagaaggacagaaatgatgagaaaccaaccaaggcctcactgcagactctgtgtagttagggcacattggaaatgaggccatgtcctcaacaagaagtagaattagacagcccagcaatattaagcgggccaacattgaaagaagttgttgccagcaaagggcataaaaataataacaacaaacagaacatttaaaatctattgggcagaaggaaaggatcagagaagttgtttttttgacagatgaaagctgtaaaaatctttctcacttctgacttttcagaaaagatcagcagtgaacatttggttgcagcaagttctagttatacattaggaaagaaggcaaactctagacagggggtgatgtagttcaagatgacccagaaatatgggatgcattgagcttagcagggcccacacagtgctatccaaaaggactttctgcatgggtgggcatggtctgccccagtggtgtccaggacagtggccactggccacacatggctcttgagcactggaaatgtgactactgtacccaaagaactgaatttttgaattttattaacttttaatcactgtaattataattaaccatgtgtagctgagggcttccatattagacatcccaggcctggaatatattcccccaggtaatgtgagatgtcgtgaaggagccactggcctcctattttgagacatcacatagaacagataataagcccaaaaactggggaagggccagtgtcacaattgtacttttctaagagaaatgtgaccactggaaactacaggtttgtccaacatctgaaggtacatgggattgtaccctcatagtaatgaactgttatgcatcatcttcatgcttgttaaacttgttattcattattccttcaagaaatcagagaatgcttattctattatagagaatgaagttttgcctgattctaggatcacaaataaaagtcaatgaattttcttttaaagaaatagttattgagtaatacatatgaggtcaactctgggagccatgtggtgaacaaacagaccccatctctgccttcatctcctggaaatgttcctctggcaaaaagaacagacctctgaccaataatcacattgatgtatttaattatagtataactataaaaggtactgtcaataaagaggacatagtactgtgggaacaaataacggggcctcagacatagcagaaggcagcagggatggctcttctggggaaatagcatttaagtaggagttagtcacgcagagatgtagcagcaggtaggtgggaaagggcattccaggtagagggaacagcatgcggactggccctggggaagggaggactttgacatatttcaggaatcataagaatgcagtgtagctagaatgcaatttgaaatatcatcaggtggtagagccttttggggcaacaaagcccagtggttttctcgaccatttatgattagcaggggaatcctttagtcaaacaaaataaaatgggtaaccctcatgataaaacaggtaaaagcagctgtgctcaggtctcctgtgtgcttctgcacggaagtgccttcgctaagctttgggacttgatgaaggtcacgtatcttgataagagcaaggggaaatcagcattgtggtcatctggccccactgccaaaggatatttctgctttactgcaaagcaataattctgaacctgctgtcagggatttcttggcacccctttaaaattcagttttactcagcaaatatttttgagtgcctactatgtgtgtcaggtactctcctgggagctgggaatatctcggttaacaaaacagaccatggcacctggtggagctaaatttttgtgagctcgtatttagacaatgaaatatgggctgggtaagccaatagcctttctagttgcagaaatccttaggttcttatgacagcactgtggacaaataaaaactcccttacccacttgtcatgggggtgtaggtaaaagtggaaaagcaaatgggcagtgagatccgcagtcagtactttgtaagtagggcttgcaaaggaattaccaggaaacaagaaatcccctggagcctaacgggtctagttttaccccagttttttgcctggccttccatcagcctttctccttctgtatttgttcagacgcacctagctgatgatttgggcatgagttttaatccagttcagtgcattcttcaatgtgatacagcatggttgctgatggggcccagaggtcgggctggacactcctgtggggaagtcatgtgtggtctgttcagagtgcaagcatgtccccttgcaactgcatgatgcatgcagctcctcacaagagcttggccatggctgaaggactgaaggggctcttccccaggaggctggctctttccctaattaagtggcagttctttcacctggtgcccaagcaagatggtcttgcattcctggtttctttcaagcctattagggttgaaatggctctatttttaaaaggccagtcagtttttttccactgtctctcggggtacttaggacagagagagcagacagtatgacacatcccaaagtcatccttccctagtgaccactagccagtgccccaggaggtcctacatccacagggtgggttcttgctaaacatgactttctctgaaagacagaaatcacatcttttcagctgcccccgccccaatccccagcttctctggaatcttaattccaaggtgcagtgcatttttccatagtccctagtccccaggtctccagagggcccgggcccactcctagcatcccctctgtgcagtggcttgagtgagaggttagttggcgtgactgaaaccaggacttgggattctcatgttggtgcttcttccagcagctctttgagaaaaccaggaaccactagcacatcactctcaagtctgtcttcccgttttttctggaaagtaaaagttactgttaggaaaaaagattagtgtttgagaaaacaaaatgttggtgcgccttctgtcagtggcattctagctgcctcaaatttcttttcattttgagtcagggaataaacgaccaaaatgtacttagtaccctggccacatgtatggaagccaaaggcagaatagcgacttgggttagatcacaagggagaagcgtaatttcagccacatctatcttcacaatcactgctcctctacattttcgttgaaaaccatcctgacttaaataacctgattcccaatagtgcatttggtttcagtgctgtttccaaccagtttaaaacaaaatcacaagccttgaagaatttgaagaatttaaattttatttctacaaaggataattattgaaaggtatagcttcctgggcttatggtcacacactggacagtataaagtgaaggtgtcttatttttggcaggtgtagaaggaactttgggtaaaataatgaaacagttttaacacacggatttggaaatgtattcatgtttattccgtgaatgattttctctgctgaaggactgtgttaataaatattctgccagcaaatatattttctaaaaggaacttctgaaaatatgattttgaattgcttcatggaacttgctggagtcttgggcctgcccctccttcttatttaattgctttagaaagttcttagaatgcagtctaagaggcttaactgccttcaagaatattgtagcagcccatcccgaagtgcttattacattagaacatttagtgcttttaaagatggtgtgtgtgtgtgtgtgtgtgtgtgtgcgtgcgtgtgtgtgtgtgtgagagagagagaaagcatatctaaatgttggtaccaaatcataccccattggaaagattcaattttctgaaattccacctaagaatttttgtatgtatatatgaaggcaattgtgaaattatagagaattagcaaagtttatttagaatttgaggggtttggagtgcagttttacagattttctgactctcttttctttaatgtccatgcagagactaacataattgacttttagatctttatccagagagtcaatccaattcaattcaaaaatgtttattgccagtccactctgaacaaacaggatgtgatttctaccttaaaggaatttacagtctagctggggctcaagacacatgttgacacatttattgcaatacagagtgatgaatgcagtgagaaaagtggggtgagctacaggagactggcagacagactgaaaggtagcacagagggggaaatcattacatttggggacctgggggtgcagtagacatcacagcgtgctctatgccctcggtggctggttcagcaccccaactagaatgagacagtgccatgaccttgccatcccaaagcacagtgaggttatttgtttgctttttctattgtaagttagagaaatattgcaccccatttatgaggtactaagtttccaagacacaagtgtaatccctggtgatgtgaagggaggggtccagtaagagaaggcagttgacatgtggtgctgccaggtgtctgtgactagcacagacacatatcactcaccaatcatggcactcttttctgttgatctctgacaacacggtgaaccaggtagtttctaccaatctgtgaggttgggatccagaggatatcaattgacaattaccagaggatctgtttctggaaactgagtaagaagatgggatcttgttggatgcattaatccagagacgatggaggcatccaaggactggagcgcctccttgtcacagagtccacaagcagagtggttgagcattctgggagtgtatttggcagcagcagcactaagaggatggcggtaggagacctttggatagttggaaatgcccttcagatggaaagcattcgccatctttagtttttctgtgtcccggtgctgtgtcctcattcctgtcttcctcctgtgagttgagaacggggcaggtcgtgctctgatgctgcagctcctgctgcttccagtgtgaaggggcacctggcagagcagagctgcctttcatgtcggacacagaggagggaaaataacaacaaagttttcctgctttagaagagaactgcaggaaagatgcagcagagagagctcttcgtggagaataaatgaatcacggaagtgtctattttaggaatctttactcttgattaatctcagacatagaaagaaaagaaaggaaaacaagtagccaagaacaacaatagtaatgatagttgtcatttaaactatgcccttcttttccatgttatataggttcccattctccaccatattgatgtctgaatcttttatattttagcaaggacatattggcaatggtcagtctctatcatggcgtctgcatgctaaccatgaaaccgccacagaagaatttggcagaaggtgtcactgaaataggagtaagtccttctacttctttctgcattcgtggtggttgggacacaccaaggatgaaggctgctacagttctaaggaaaccttgtggctttatgggagtaaacctgtaaaactggttccttctctgaacattctttctgtaacacttaaaaaaataccaacagtttgcaaaacgcttctaagaatagaaaagaagtcctcccttacctcaataaaatgtgggaataaaatgttgagtacaaatgcctttgaactcagaaactggagaatttgtaatattttacttttgtctgattgtgaaacacatgcctgttcattggagaaaagttgtaaaacactaaagtaccaagtaaaaaatactaattatatcattcagatataccattaacatttagtatatttgttgtcattaaaaattctataaacattttttttaaatctacataatgctttgccattcctaagagattaacccgtataataattttcccctttttctagtgagggtttatttttgacattaaaaatactttttttttttttttttgagacagagtctcgctctgccacccagcctggagtgcagtggcataatctcagcttactgcagcctccacctcccaggttcaagcgattctcctgcctcagcctcccaaatagctgggactactggtgcacaccactactcccggctaatttttgtatttttggtagagacagggtttcaccatgttggccaagctggtctcgaacttctggcctaaagtgatccacccacctcagcctcccaaagtgctgggattacaggtgtcagccaccacacccggcctaaaaatactgttctgatgaccatccttgtgccaaaattggtgtctccatttttgtctatgtcattaggagagattcctagaagcaaaatactggtcaaagggttatggacaatttaacactcctctggaaataaaggacatccatataatgtggcaaataatttataaagcatttcaccagggaaatgagatttgccttcatgttttcattcattcatttgttcattcgggaaacatttattgagctcctgctgtatgctttcactgttctgggcgcaagagacacagggatgcacatgagaaatagtttggctaaagggagaagacgatccagaaacacatcaaagcaccagatattatcagggagagttccgtgaagagctcagtgttcttgggtcatgttactgagttgattggtgaggagggagacttagagcttctttagattgtagatccaggaggcctctctgagaaggtgactcataggctgggactgaattacaaggagacaccctatgaagaccagggagaaggaggagcccttcccaggaagaggcgcagcaggagcagaggccctgcaggggacctctgtgcatgggcgaggggaggtggaaacagctgcagggatagtgggttcaggaagcaaaacatgagtgcagatgttgacactgaagggtctagaggcaggatgtttcccatcaggtgaagaccagggtgtgcagcttttggagagtatgcatgacctgagaaggaggagaatgttctgtgccggatcagacaagtgaactagaaaaggttctgagcacctttgtggatgagccactgagtcagaaagactgcagcacaattatgctcaaatgtctcattggagaaggagtaggggagatacatttcttatatgattgtaacaagcaaggaaaaataacccaagtgtcaagctaggaaaatgatgcaataaattatgatagacttgaagtataaaatattatgtgactatttacaatcatgcttgtgaagaattttaataacataggaaaatactaacactactatgttgaattttaaaagatctaaaattatacataaaaaactatacacagttatataactgtgctattatgtatagtttgaatatatataatatgtgtgtgtgtgtgtatatatatatatatatatgtattcaaaaaatgtcctggcatagagtggtccaaaatgttattagtggaagtctttgggtggtagaattgtggttatctttaatttttatgtttatccttttttgcatctttcaaatttttaatgatacatgcatcacatctaaaatctaaaaaataaagtatgtcgacagttttttgaatgccagaattcagacgaaattcatcgcacagttattcaattacagaacaagaaactgcagaaagaatagaggcattagctagaaaaacgttggaaggaaccatgtaacaaagcaagttcctcccaagaatcaggagactttatcaaactcctcattagaggcctagaaaaaatacctacaaagaagcaagaaatgtggcacccagagggagaaaaataaattatcatcttaacagaaaggcattagacagtgtccttgaggaagcgaacccagcgtgcggtcatggcctccaaaagatagaagagaaagaaaagaaaaaaggaagcagcctcattgtcatgcatctcaggacacatttagaggagaaacagaaggtgctgtgctctggcctgggttgctaggctctctcaggctatctcaccacaaggaaggtggtcagagaaagagaacactcagggacaataagtatgtatcagatcatgagatgacaaaatggcagaactggaggaaatacgcctcttcatccctggttgggttgaaaaataagcgtggttctctcggggaggtctctggattccaaaaagccgaaaccacatctaattttggttttggtcatagccccagcaccaagaacattgcctggcacataataggtgctcagtaaaccctgaaaataagtgaatgaaagaatccaatgaaccatgatttgaaggtatctcaagtggtgacactagcaacatcttcattcaccaattcattcgttttctctacaaacatgtattgaacattttcctgtgaaaggcaccatctttaaaataaaaactggttcacaacaatttgatgagctcagtgggctcacattcagttgtgacagggagctgtggtgggagttgtttctggaaacatcccagccttttgagttgaagtctagggagaagccacataatgctgttctgctttccttggtgcctaagaatggccacacatttacgatttggtttcttagtccctgctttccaggtgatgttcccctctgccattttgggcaccgatggcccatgggctggctgctgtggaggatgcctgcttgaacccagggtgatcacaatctgaatggtgtgatctgtgacaccctgagcacacttttgcatcagggctcccattaccccttccttaggtgctgaatctccccatgttcccaaataggtgttacccaccttgggcctgaattggtctttctttgaattcttgcttcaaaaagaaagtgttgggtttttctttagggggacaatgacgtggactttattttttctaacacaagtcttcagaactctgtggtatcctgttagttggcaggacagtaaagtcaatatttgggaaatgtcaagatatgtttggactttgccttggacatcgccgagcagattgatgtttcttcctcccaagtctaggacctggatcttttaagtgcatccagcagcaagaaggaagttgaatttcccaggcaactgaaaaccctggctgttggaacaatcttgctgtgatgcatgagtgagtcaaataagcttgagtgatttaagggaaacaaatatggagcaacagggtatcacttggaggagggtctcattggcttcccctcaaagctttggccacctttcagtcagtttgaataattgtaggttatgcttttgaagagcagaaacgcaaatgtttcacttgagcaacctctgacgcgttgatctccagtagtacattataactttgggcatgaggacactgaatttcccttgacactgtcaaaatagttgacaatttttttgtacatatttggtgaacttcctttgtgttcatctcaggactgtcggcatgtcagaaattcacaatgtgagctaaagaaaagctccatgatagtccccaaccccagcccttacttgttcttcactgtatttttaactgtgagtacacggggtcagggtcacggcctcttcttctgcaacaagctaggaaaacctcttgaaaatatgaaattacagtattattgagtataccactaggcaaattctgaactccagtaattctaggaattcagtgcatttggcctgcaaatttatctctcactatttttcttcaaatccatccagtgcatctttgttttaagcctaataaaattaagccttaataaaattattcaggcaggagtgacccagacaaagaaagatgggcttggttggggtggcaagacagaactgtaaattcatggaaaaaaccttttgataggataaagatgggaaagtcatgaagaagattgtgaccattcaggttcccctgtgagcgaaatgccaaattgaagaagaaaagaaaaagaaggaggtggagaaggaggaagaagagacagggaggaagaagaggaagagtaaataaggagaaggagggagaataagaagagaagaaacagaagagggagatgaggaagcaggaggagaaggaggaaaagaggaagacggagaaggaggagggacaggacgaggagaaaggagggcaggaagagaaagagaaggaggagcaagaggaggaggaggaggagggggggaggaggagcacctgaaggcagcagcatgccctgatgaaattcttttaagatctcccacagaatagtatagggtgcatattttggatgtcactttgacttgatatcttttaaagaaagagaaaatgggctgttttctcatggcctgaatcacttggacttcatttgtgcagtaacagctgaatagcttgcattcagcccctaaactcccagtaaccagccaattgatattactttggaggcctccttctctttgatgtatctctgttgaacacatcacaatgtttttgggataaatataaaagatagttcaaagtgggaagagtggcttaaatggggaggaatatcccaactggtggttgctatcataatgcgtcatcttggcatgaatgctctaattggagatttctgatgctcaactgggacacttctaggatctgttagctcctgaagtaattttcagcccttttgcctttgggctacctacttagtcgttgagaaagaccaaacccagaagtatagggccaggactagaagtcttccagaattggactggacctatagctagttacattttcataagtcagaccattttctgaaaacagaaagaaaatggagaaatgagaacttgcatcattacatggtttatgatgcttcatggagtatcttgagcaaaaccaagatgcaatgaatatttgttgtataaataaatcaatggtaccagacattggggtccctggtctctaggacagtggaaaagagcagaggaattggaggaaatgctgaagagttagaaaaattttctaacttctcttcaagcaaggattactgtttcaggtgggccctttgagctgccccgttctttaaaggagactgtctgggaagatgctccacgctgaatgttctagctgcactgattgcccccctggttgcttgtttggtttctatcaagaacacccagtaatcacctttcactttccccccaacctcacctttgcagcagactgatgattacattttgatttgcaacttcttgttctaaaacaggtaagcagaaggaaaaacatgtctctatgacattctaccatagttccccaggacaggaatattttagtcaagctctttgttagaatggcttaaagtaaatgcattgaaagaaatcatcatggaatcaatcaataggtttgacgtaataacattttaaaatttctctttataatgttatctcatgagcaaaatcaacagacaagcatcaagctgggaaatgtttgaaaccaatatgttggagaaaaaatattaatattcctaatatataaagaatgcatacaaatcaataagaaaaacattaagacccaaaatagatacccaggtaaaggacaaacaaatctctgaagagggaatgcaaatggcaaatcagcatatgatacaatgtccagccctccttggttttgaacaaaatgcaaattgaaatagcagaaggacatcatttgccctatcaaattaacaaagattctaaaatgatggtcgaagaaagggggcagtgaagtagaatgtcatgtgctactcaggagaggcacagattttctggaaaataactagcccattataaatcaagagccttaaaacaggtggatacgttttgacctaggaattcagcttctagaaatgtatcatgaggaggtcatcagaaatatgggaactcacttatatacaaagatattaataacagacatttgctttatttaaacattaattatcaaagagtcaaagtgcaccaaatcatgagaatggctcaatgaatatggcttatccattccacggaatatagagctgttaaacatggtatgtgtgtaaagagtttgtgtggcatgaaaaaacttttaagatataacattagtagaacaaaataggaaaatatcactacatatcattttatatattttcaaaaccgtaaagagactggaagaaaatactctaaattcttacatcagttatctcaggacaatgcaattacaaggaactattattttctttttaaacatttttttctccaggttttcagaaagggtatcttttcctcttaaaatagaagagagaatagcattctctcagagaggccctcagtcaagatcaatgacctcatggtttagtgttatcttagagcatgaactcaatctgtggacaaataacctgtaaattacataatgcatcatatcacgtttccctttctgccttggctgtcaaaaacctaaggccaattataatgttcaaccaaaataaataattatcttgactttgtattgagttttctcccacttctttttatatcacttcatgaattttatatttatttttacagccttatagtatgtatctttagttagaaaccacttcaaattctttttattttaaaagtagttggctctctcattataatacctataaatgtgtatatcgagctttagagtcagtaaaaagcattgaccatatttagttttgatgtgttgtccagcagcaggggtctttgggaagtgatataaggatcctggtggtgttgagagtggacacgcttgtggatacacaggtatgtgcacaccactgacacactcacacctgctcatcctgcatgttcattgtagaatataagcctcagggctgcaccttttcatgcctgcatgttattccagaactgtgtaggctcctgtgccttgattgtgcagtgcacggtgtgacctgaatgacagaagccacctcaccaaagtgaggcagaactttattacaaaccctcaagtccactctcccgcatgtctatagaaaagttgaggtggaaacaactgcttccagccataccattcatttttcctaaagaaaccctaagtaagtattctaagttccactgtttaaaaaaagtgagataaaacaacctttcaaaactaactctgggctcaccagaatgtataccttaaatgtgtacaagattttgtgtatcagttatacctcaataaagcttaaaaaaaaaaaaactgaatctaggtccctggtcagggatttcggctttctcttagggtgaggtattgttcaaaattagcatgcatttcagagaatttgttctgtcaagtgaattatctcatcctattatattccaattccaggaggggaaagctaagatatacagtaaacctaaagtcatgattttagacttcttaatgtcttaaattaaatgtcttaaattaaaaggaaaactcaccaagactctcttgtccttgaaagacctttttctctagattgtgcaaggtggtaggcatatcatggtagctaagcaaaggtcaggggttcagacaggcctggctttgaattatatctctcctgcttattagctctgtaagtttggcagtgatatttaactccactgagcctcagttttctcatttgtaaataaacccagtaatgatagttaatgtgttacatgtttactgtgtgccaagcactgggctgagtgcttcacacatatcgactcatcccatcccccaccacctcaccaaggtgggtgatccatggactaccatggcaaatggggaaaccaaggcacaaaacacaacacaaaaacaaaaacaacacaatcatttgctaaagttctgtgtgagcttgtaagtggcagagcccagattccgattcaggaaacgtggcccttgagcctgcattcgtaaccaccctgggaaggtggtatgggaagacaactccagccttgtagtagatttttattttatggctcgccagctaactaaaatcctttcaataaattgtccttctgctgagctcaggcagaggggcttctttctcttataatgaagacctttgattgataagggtccttctccctcacagacaaggacaccagtgaggagagtggctctgcccaaggacacctgcaagccggtgccttgtcctgctggttcccaatcagtgcacttccttgtttggagtaaattgatatagtacaagagagattcaaggaaaagatggaattttagcagttcactacagagagcctgtaacttaaataggagagttgagtaggaattttaggtttggaaccaagaaccttcactcattcccttgcttggtcatttcattaagactgagtgtttaccacttcctgggctctgtgctaagtacttgagatgtgaatgtaaggagtcttttaaggagcttcctgtctatgggggagacatgcagatacaataaaatgccaccagtcgtatagcaaaactcgcagaaggtactgtgggagcacagaaggggagcagttaacctaaaaccaaaaggagcaatcttggagaacttcttgaagcaggtggcacttcagtttaattttttaagaataaacaggaattagacaaatgaagggtgacaggaaagacaagatagactggagaggccacatacacaaaggccgatggcaggggaaatgttaggtgtttgaggaactgcaagtaatttggggtgtattagaccagtgaggaaaaaaatagacccgtgaacaacctttagcattaaaaaatttaattttatcctgaagacagtaaggaatggtcaacaggaagtaacatgatcagatttgcagtagtgtagaaaatagattggagacaactattggttaaacatagtgcattatatatgtgtttatctttgttctctccaaaaatccacggaaatgataataacataaaaaaagtcattaatctgcaagtacagacagaatggaacaatagcgggcagatgagaggtgtcaactcagttgtacaagatgtcaagtggatggaagcgtgatacctcatcagtgaactagagacagtgggatccctgcttctgcaggatgggaaagatgagacaccaactagaagcaagctgattcacattgagaaaccttgaaagcttcagaaatcagggtgccagatatccataaatgtacagacttgggaaaggctgaaaacagaagaataagttgtttattaggaacaattacgtaaacttctagatatgctctcttcccataccacacagtcaggaaaccagcctgcaccccaaacctagcagaactctgaaggcacattttctgagttgaactagaaacattctgactcaggcatcagccgaggtgaggatgctggatgaggcatcacattacaatagtgggagtaagtgaaactctacatactgaatggtgagacccctgcctagcacccagaaatgaaagccagacctgtactctctaggtaggaagttggaggagtggaggagtccttttgggagaaaccaatctgctcaaaacaaaaggcctacataatgttgacattggaggtcccctgagagattgctagatccctgcctgcccactctgcagtgaaaccctgaaggaaatagtctcatccttcacagaaacagagctttcagtcaacattttagctcctcactcaaatatgaaaaaacaacaagggatcattaggcacttgaaagggaatggcagaaaccaaagtggaaaagcaggacaaaaaggaattttaaacaaacagagacagcgtggagcacatatgaaacatcaagaaaaggataagtgatagcttcaggtctaggagaagttgttgcacccatggaacaagaacagcatgctgtataaaaagaacattcagagaacacaatagagctcttggaaataaaaatatgtaatagcaaaaacaaaaaatccaaaaaaatagtgccaacataaagttgaggaaatctcccggaaaatagaataaaactacaatggatggaataaagtagggggaaaaaaataagaaaattagaggactggtctgtgcaatctaaaacccagataaataaaagttatagaagcaaaacaaaacaaaaaacagtaaatggaagaggagatgaaattatcaaagaaaaatacaagaaaatatccagctcataaatatgagttgactactttgaaagggctcattgagtgcccatcaccatgaattgtaaaagaccctaataatataatatataatataataatataataaacatcactcctctttaaaagaatgagattcttagagaagtggataattctaagtctggggcaggaaatgcacaagatggaacattatatcaaaccaaatagcaaaacagtcatggaagtaagtctgtttgggtcatgtcagtgggactcaggagccaatttggagagattcccactggccagaggtgtaatgatttgagcatcacttagaataatgactgtaatgaatcagacatgtttcaaaccacgagtctattatgatgcctaaaaaaagaagtcattggccacctttggaagatgctaggaaatcaactcattattttgaaagctgataaataacaagaaagaatcaagcatttattttgtctttcatgtaaaactgtagttcaagtaaccaaacagttgatgagagaaggtttctctttatacaagtatttcaactcataaacaaagaaggaaggaaaacaaatgtgaacttcaccacactgcatctcctggtgacataaaggatctgggccaagatcactgattattgctaacaccaaaaggagtgacaagcagacatttgtgcttcctggtggaagtacacaccaccacctgtgaggccctattgccaaaccccctctcctgctggcacaaatcaggcagtaaaaagctagcttcttttttttttttttcctgggcatttaagccagaagagaatatgttttgcagaggctcagtttacactgaatgcaaggaccggggatctggtataaaggtttttgcaagtgatggatttaatacttaatgactgatacagagcctctaagcaaaatttcctgaatctctgcccagaagaaatgttggaggtttaacccagctgtccatctgtcatgtggaccgtctctgcagtccctcaggcagatcctgaggggagggatgtgaaggggctgggaaaagggtgtgcagcctcctgggtaggatctttgcagcagctgccctttcctgccttcccgtgggaggcagtgctggaagctgcacagcatctcctttcacttctgagggctttcagagatggaggccacacgggctcagggacattaattccaggtctcgccatgtcctcgacagccaagttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctgttgtttcctgactttttaatgattgccattctaactggtgtgagatgatattccatgctcatgggtaggaagaatcaatatcgtgaaaatggccatactgccattttcataatttcataatttcataatttcataatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaacacaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgacagccaagttttgagttttgagtttcttcaacagctgagcctgaacaagggcttcagtttaggaggaggagacaggaagcaaggtaagcaaatgagacaggagagctaatattgttgcaggacttcttccttagttcagctaaagatgtggatccttatcacacgcccatgaaaatttaggcttgcagacgatttgaagagtgagaaaaacgggatttactgggcaaaaaggaaaaaaaagtggggggacagagactcttagcaaagcaagagagtgtgctttttggccatgggcttcgcgcctcacagcttaaattccaggttcaacacaggaagaagaggggccaggcttctcccttctgcaaaatgcacgaacttccggagcctccaccccagtggcacaggctggttagagttttgccagggaactcttcgcacctggctgtctcaatacaagatgtgtcagggagcgagttaccactgtggacaccgggaacctccgggagattgtgaggaacacgcctcagcctcagagttgtcccatccgggacaaagaagtgggagtctctttcccccagtgcttgagggtcactcctggggtgctgactctctggcagttctggtcgatcctactgagtgtgttctctggccagagaacacatgcagactgggtagagctgtctgcaggtaatctctgagggaatctaagtctcccccacatggccagtaaatggcagagctcagagcagaaccagaccatcttggccacagtgctgtgcttgtagcctccgcactaaacaggtgttgggttttttaaataaagctcagatctggaacttggggagagagggcaggctgctactggctagacgtgcctttgtcaagcaggtagtgacacaggtattgtgtgttgggagagcaagcagttacgggagtagggctgcacctccatggttctggcctgatgtatcccagaaagaactgaggatgcttgtgatcagtggggctgtcaggaacctggcttctgacctgggctatcctgctctcaacatcttctgtagttttgttgaaaatgctgacggtcattctcaaccctggctgcacattaaggtcacctggagaactttaaaaaatactgatgcctctgttccttccgcagagtgaggtaagtaattggtctgcagtgagtcctggcagggggagctttaaaaatctccccaggtgtttccaatgagcagccacagcttataagaaagttctaaaagcttaagcaggaagcttctattgcaagaaagtattattttagcaatcaggaaggaatttctcacctctttacaaaaccccacccagtgagttgggggaagaacgagcccccatagaaggatgtgtgagtgagcccttttgcctgcaggcctctgatggaataagagagttacacataagtgtaattgattagtaattgataaagttaggaagtcgcttatcagtgtcacctcctggccataaaactctgctgatcagtgatgctactttaattcccaagcttcagttttcacatttataaatgaacatattcatgtggcctgagcaaactcctatggctgggcacctggcatgctcagggcagacacactggcagctcttgccccgcatccagccggtctggccaagagtggttcagtgttctgggccacaactaaggtgctttagcagaacagggaatgttcgattttctcagccctactggtcatccagatgttgtgggagggagacatttgaggggctgagctcagaaggggccatctcccttcctctagcttttcctgctttcccgctcagccccaactgcagaaactgaatcctagcagcagggtgagtgcaaagtgataaggggcctttgctcggtctgaaaaagatggctgtggtaattaggacaaaagaaaatgtagctaggccatttaaaaactttgcaggatgctttccttcccaaagaatgagctaagcaggagcccccgggaggtgtttttaatggggctaagcagcaggagggtttgcagaattgttttctctgctcccaggggttctgtttctgttttggtataggcaccgaacttattggttttccagagctccatttgttgttattaataacacagcatcatccagagcttgagcaaaggcaggcagcaaggaagcaggaatcctgatatttagagagggctgcatgtttagagacatccctgcccagcccccacagtaggttggttctctggacattgagggtgccaggtcctgacagtgcactcaggatttgaagccaggtcttcctggggagcttactgtttagtgcaggatgccaggtttgtcggtagtcagcagttcatgtcccacaacagagtgcatgatacgatggaggtaggcacccaagcctggaggggtaggggaggggtgtgcaggaaaggagtttgtctcacaaagagtcttgtctgagatacgtttaaaggaagtgaagttatgaagcatgaaaaggaaggaatcccttaatggtgggaggaaccacatgagccatagcagagcgaagaggaaaggcatggtgtgatctagaaacagtagacaagtgggggtggctggtgcaagggaggccaggggtgacaagatataaagctgagagattaagcagaaaccaaatacccaagacaatttcctgggtccgggagcatagacttgactccaactccttccagcttttcattttgaaacgtacaaatctacagaaaagtttcaagaatagtaccataaataactgcacattctacacatggattcccaacttgttaacaggtgccacattggtcttctcttcctctctgtatatttttgccaaaactttgaaaataggttatagacatgatgactaaataattgagcatggggccgggtgcagtggctcatgccagtaatcccagcattttgggaggctgaggcgggtgaatcatttaaggtcaggagttcaagaccagcctggccaacatggtgaaaccccagctctactaaaaatacaaaaattagccgagtggtagtggtgtgtgcctgtaatcccagctacttgggaggctgaggcagaatcgcttgagcctgggaggcagaggttgtggagccaagagcctaggttgtggagccaaaaggcttgagcctgggagccaagattgtgccacagcactccagcctgggcaacagagtgagaccctttctcaaaaaaaaaacaacaacaaaaaaaaaaaaaaaaaaaaaaaaaacttgagcataggtctctaggagaaaaagacattatcttacataaccacaatgtcactgctattctatggaattgaacactgaaaatatattgaacgtattatttgacactcattctatagttaaattttctgaattatcccacaaaggaactttataggtctcctgttctttatggagagtctgatcaaggaagacataagaacactaatggccaatacccgcaaaacatacccgctaataaaaatttttgggctgggcacagtgacttacacctgtaatcccagcactttgggaggccgaggtgggcagatcacgagttcaggagttcaaaaccagcctgaccaacatggtaaaaccccgtctctactaaaaatacaaaaattagctgggcatggtggtgtgcacctgtaatcccagctactcaggaggctgaggcaggagaatcacttgaacctgggaggcggaggttgcagtgagccaagattgtgccactgcactccagcctaggtgacagagtgagactccgtctcaaaaaaaaaaaaattaattactggggacattggctcttttatctcttttaatgaccagcccccggcctttttgttgttactgttgctttgtttttcttgacattatcatccgttaagagtacaggccagtcactttgtagaatgtccctcagtgtgaggtttgtgcaattgttcactcattattagattaaggtcaaacatttttggcaaaagtaccacatgggagaggtggtggccttcccgttgcatcggttccagaggttcatggtgccagcttgtcccagtattgctgtcctaagttgtccgcttgatgtctctacagtttttccattttaaagatatatcttactcttcataattaagggagattttacagttctatcttccattctccatttgtagcttgacatgcttctctgaagagaaactcccaccacacacttctttaaattatcactgtagactcctgggattcatttttttattcaatgcattataattcattagtgtcattccttatgcatgttggtgctcaaattgtcccaaattgggccagtggttgctccttcaagccagctcgtgtgccttggatggtccttactcagttttgcgcacttccaggcttcctgcctaactttgtgctttcttgccctgaacttggaattacacttttccagagagccctagttccttttagtgaggaataatcactagaaacccaggtccatgtgctaactgtgctttattgctaccgaaatatcgctgcttctaggcccttcaagtggaaagtgcttagaaatgtgtattttcccaaacttactagtttatgccaataacaccaattcaacatgagattcttcctcacttcctcccattccatatccctacattggttctcaaatatatgaatatatttacttatttgtgctctgtattacaatatacacaaggttgtttccagattactgtataggtaacaccaccaccaacagcaaacttaccaggtaaaatgtaagatttcttggagctattttctttcttagaacatgtcccactatgggcgtacactcagaggactgtgtttaaaattacttaaatatattatttgtggttagattcaattgtttatatacaactttaggcttgtttatctttgaatttattttttggaaatgcaaaatgcttacatttcaaaaagtcaacactatataaaattgtttatctagccagtgtcctagggataggcacttggattgtttccaatactttgctatcacaaataatgctgtggtcagttattttgatgcatggatgtattttcgaggtaaactcctgaaaatgagattgctgcattgaagggcacatgtgtgtcattttgtgagatgttgccacattccactcactaccggctgtaccatttgagtttgtattggttctcttggggaatggatttgagaggaaatgaggttggacctaggagcatgggtcaggaggctactgcggccatccaggtgggtgatgaggaatacctgaaccacaacagtgggactggggagtgagaggaggggccaggctagaggcttggcccttgattggacatgagcagcaagggcataaaaagaacagagaacaaaggaataaaaagattcccaggtgaatgcgtgaaggggaagcaggcagtttggtgtccacactaggacaggaaatacaagggtgaagaagatatgcatgtatgtgtgtatgcctgtgtgtgcgtgtgtgtgtgcatgtgtgtgtgtgcgtgtgtctctgtgtgcatgtgtatgcatatgtgtgcacacgtgtaggtgtgtgtgcatgcacgcgcaggaatgaatgccatctgaacacgtggagtttgggaagcagatgcccaggaagcctggaacaccaggtgaggtggggctggcagcagtgagacaccggcatgaaaaaagcagcaaaagccatgatcgtggatgagatcagtacacacatcatagtgtccccagactcggacacacagggaaaatggtgcatctgctttacttttgtcgggtgaacaagtgaactcattgctttaaatttcaaggtatttcatctgaagaggcatctggaggctgaaaaaaatatattgagcatattatgtaaaaatgtaaatactgtttagaaagaaatcgattttatgtttcttgacttttcaaataccatttgcgctttagtgttccactgggggctgggggaaaaggtaggtggatgcagccttggccccaaaaatgaggtgtgaagacgctccctgtgaaacaagctgctatcgggaacccggagtccattcccactgccgtgcctctgcctattacaggccccgccctccgacttgtcctcctcccaggcctgtcctgggctgacccagagaggataaagatctctcctggaaaaaagtatttgctggaggctgggaggagggactccaggcagtgggaaccagtgggacctgtagaggttgtctggaaaggggcttttatctcccgtcagggaacaggctcttcatttccagaggatagtttatgtttcgctctgtgtattcatgcacaactttaatatcagtggattaatccacagttttagaagcttatcaataattctgctgtccacacacatataacaaaacagcacatttgcagtaacacatcagggatcttgcgttgctgtgctcctcatatttgaattactcagataattggaagtccaacgtttggtttggacttatttcagtgcagtcttttgaaaatatgttcttgccaccttgcactgtgtctcgtgcacattcctcagccgtctctccatgcagtagcagcagcatgagcccggtctggttgtgggtattgcagttgctgtttgttcccttcacgggtggccgtcagcttctacttctgttaccttctggtttgcctcaaccagctcatttcacaccagtacaattcaatcagtgtgcttattgtttgctagcttaaacattcactgagcttggacacagcactcaatcgacaccgtgttaatactgtgtgttaagtaggagtcattagactctgagggacttctcaaaaataaatgtctgactggagttcagggcactgtcagcaagggctgcgaaattctaaaatgggaacaaggatgtggaggaagttccacatttgcatgttggtgtctaaccactggtacttgcaacagacattattttccccaaaatgataaaactgccagagccactgagcaaagtaagctacagtgtaattgctcatgtgagttctctcctttgagtgggcaggatatggcatggaccatccttaatcctcatcggggaggcagaagagaagcagccctagattgtagttccgagttcttacccactccagattccatcacttcttggccacgtggtgttgggtacgttgcagcttccttatctacaccttccttttctctaaaattgtagctatttaacctgccctgcccaggaggtgggtgtgaagaggctttatgcaagtaatgcagtctacaaacataaactgtctttatcagtatcgatatccttacttgcaagttggggatatggcaaatgtgtaatagacaagttgtgaattgtggttttgtcagctacagcaagcatgggatgccttctttccatctttaggttcttccctccccctccagtgtttctgcccaggaatttaaaacagaaatataatgctattttttagaaatcagaaataatttcccctctgtacactattagcagccagaaactttcatttctctgaaggttactaaatgcaaaagaggtatgaactgtgtttaacaaaacaaaagcaagcaactcaactatcctcactgttcactcaaccatcctccactattctcacctttacctctgttatcattgagaaaagaattgatgtattgggttgacccagaggaggctgctgatatttgatcacttctggcatgtcatttttgtatgctcaacctaattatttctgagaaaagagaattacacctttggttcaggattatccaggcagcattgcagcataatgctgaaactctcatttttatggtgcaaagccttgaaagaagcctatggaaagcgtgtgagtaaatgcagaggtaatacacgcactatctctaatactttgtatctacccctcattcaggagacactgttctttcttgagttaagcttagcccgggaaggacacatatttatgtggaagacgatgagagttagacttgaatttactgtgtcattttaatagactgcttcatctacttgacaatgaggttcttccaggattatcttcgaagccctgatgatctgctaaataaataatgttctgggccggccgactctatatatggtcatccgagagggccataaatctgtgctcctagggtagcaggagttcagttgtcccatttttatttctaactgacccataaaaggcatcttcagtgttgctgattatgctctcctcatttgatttggagttatgtcaccctaaagcagggagaatttcctcacaataaatctctcatttttaatctcgagctacagtgggaaagcctgtctgcacagctgagaaaaaaagaggagggcctgggctgtgatttaatagggtgaagggtggggaggtagccaccctaggggctgcacaaaggcatctctggggaagccgctgggaactgagtcccaagggggagagggaaggaaggaggaagggatttggtttgatctttcttccccagcccccgaccccaccctaatactatgtctttctttgagctaagatttggctcttgctggggtaaaggccacctttagggtttgactccttggagccatcatctctgctggcactgatcttacagacatggccaaagacatcattgttcttctgttttctgggctcactgaagacagacaaggcttaaagcagagaagatcaataatcaaaacagagttttcccttggctcaccgctcaggcaggtgcaatctccagcccgaccaagggtcttgatgccaaaagaaagaaaataaaggaaggagggaagttgggtgaggaagagaaaaaatagggagggaggaaaaggagggaaaggaccagggagggaaggagagcaagggggaaggaaaggccattctcccagtttatttatgtggaatttaaaaacagaacgtggactataggatttctgtagtcttcagggagagtgctaatggggaaaatagtgcatagaaatgcagctgatccacactagcagcccttctcccttgagatgctcctgctgcagcctgtgaccacatactcacacacacatacacatttgtatatgtgcacactcagtcaaattcacacatgcatacaggcccatgcacaagcacagctaggtagactcacacacttgcatgcatgcacacacacacacacaggcacttgcactcatggacacacatgcacgtgcacacacatgcaggtacacactcacctagggacacatgcacacacatacgcagacacggtcacaccctactccatcctgcctgttttgaattttggcctttgaagttgttgatgactttgatcagcggtggagtctgcacaaggtcatgtcctccatcctctgcctgccctcaggaccccagcacagacaggtatctctgctgggggcaaaaggagcacctaggctttggggtcagggcagtagagcagcttttatgcaccctgggaagatgctaactggctggttggccaatgggaagggagtgttgatgagcactacagtgaggactctggttctgccctcaacccagccccatgtgacatcccaaggtcatccctaggggaagcctgggtcctccgagaaacagatgccaagacagaatgaaggatgcaagggttttataagagaaatgcctataaagagggcaagggagctgggggagggttgggaggggcagtggacccctgcaccttctgacccaagtgaaggagggagagagggaagcaaggttgtgtgaaagcatccacgtgtggatggctgtgcagtacagacaaggttcagcaagaccagcagagcatcactgagtccttggtgttcctgctgtgctcagtcacaggctgggagcagccgctccatggggccgtgggtctcagtcaccctttggtcagtggtgaggtgcctgtcgccagccagataagcacccagagcctcccctcccagctgccttccaaactactactgagcaattggaggaggtagattgaaaactcagcctggagtcagaagcagtagccccagtcaacttcatactgagttgaaacagaaaatcaacaattcactcaagaaatagattcacttcaaaaaaaaaaaggtaaattcattcaaataataacttgttaacaaggtgttttctctgtctgaatttgaggagttctctctccatatccaactgggcaacacagaggcatggctgttatcagcaccgagaaatgtcagggttttaagctgccacagagaacatttagcttgaaaataagaaagactttctggatggtgaggggagctttaaacattgcaaagggttatagaattattttgttttagaattcttaaaaatcaggtttaaatcttaccgttttaaggtaagttgagtgactcagggggaagatgctttgaagtcctagctttgcaaactacctgaattctctcagcatctggttgaggtcatcaaaggcaccactgaggtgacagcagggagaggtctttgctttgaggctgacaaaatatgcagcatgtcaatgcaaacatagtgcttagcaaaagccaacccccaatgcgggtatcctagaggagcagatagttggctactatcatttttacagaatcaaacagatttatatatatctgttttatatatatatatatatataagattatatatatataatcttaataatcatcctaataaacaattttcagagtcaaaatttaaaaagttgaatcaatcaaagaagacaagaaaaaatgcctgattaatttgaaagtattagattgctttttctgtgaccatctttcagttcacctattgaactttctctcattgttcacaataattcacctaaaggcagatgaccccatggagaattccaagctgacgtctaccactctctgcctatctaaagccccaagacattcataagtggaaaaaacaaaaaaagcaacaaaagtcagcagctaaagaaagtcttcagtcagaagcttggggtctctcttgtcacctgggtgagagtcaggtaatattgcactgcggagactggctcagctgtgttgcctcagctaataaggggaatgctttgcttgctctttatagccagatgtattattaagcacaggtttacagaagcatcttaaaacactgacttagtgctgtaaactgtgaaaagtagaaattcatgtgaatgcttcaagtttttttgatgaactttcagtggatgatggtggttgtaactgtctgctttttatttttgcctagtgttccattattggaacataagcatgtgacagttatttatatcctattgctcaaggtcatcgccaaggtctgattgcaaaagttcaaaaaattgcaacctcgggcataaatgggttcaataacattagaaggactatatttcattattcaggtagttccagttaagatatagatattttatcttgtgcaaatagctctctctctaggaagttctcctcactcaggatttaatggaacatgccctttctccgcaatgtatcatccaaggcatttcaggttatatgtggggcagtatcaccctgttacttattaatagactaatgatagatgaccaaatcctcgtacataaaacatttatattttatttctggagtttggggattgaaactgggtcaaatcacagagagctcttacacaaactaatgagcttacaaaatccagatcctcagaaatcatgcagtggttttaatgaatgttccgcagggaaaacgcaccaagatttgttgtttgaatgaggcagtgactaaactcaggtcaccttaggtaagttttctccaagatgcagagtattaaacttgcatctgcatctctttgattgttttgcttcctttttaaatcacagtggttggtttttctctttgaaaagcaagataaggatgaggacaccaaaattcttctgctgccttgtggtaggccctggaatttggtaagagtgactcagtagagactctcactttgaaaaaatataaagtattaatagaaaatgtaaagtatggtaagaccaacaaattaggagacaactgccactgaaaaaatagtgcgtagcaatagcaagcaatttcaaaaggtgagtccatagcgccaaggggaagtaggactgattaccgtctcatcttaatgtctctctaggccccatggtttaaaaggactcacattcttcacataaaggttcttttcttttctcactaggtttttgacacctggccctggggtgacctgaacagtggatagtggtcccaaagtggggagtgagagtctaataaaggagatggttgggtgtgagctctggattgattggtttgtatttgaaaagcacagtcttgggtatgttgctccctatctctaggagctggttaaccctgggaggggcagtccctcagggtcagcaagatgcagtatcagagcattgaaatacaggaaatgaaagacgtgattaatacacatcactgagctgaaatgtcagtggtttaccgaacaagataagtaaagatttaggactacatttgtgctcacagaaacccccatatatgggaaattttcatgggcagtaaaaccaaggaaccgctgaactgtattctcccatggaatttcctaaacctggcatccatcagccccttttgatcactccgcagcgagggcttgggaaagctctctagagagaagcaggcagctgaacaaggtgcgagagaaaaggagcatcaccttgagtctgagcacatggtgggaacaaatgagaaaacgttcttcaggtgacctcagctcaagaaagtggacactgcaggaagaacatttcaattctggaaaaaacagaaaactttatagaaccctggtctgcactgttagcattggtgcattggtgacaaatgatttttttttcttttggagaatttgtcatttttgctcagaaagaaacaaataatacctacagtgaggcatgctatctaccattctctttttttctctacatccctctaataggcagcacagctgcctctggatggttatttgttcttggctaattacaaagtaaagggattttacagtcttacagatgggaacttagagataggatgctttttttttttttctggaaagaaatggagctcatttaatgcctaattagggagagtcacatgtgcagggtaaggggaatggtgactgctaacctgaagggaaggaactctttccttcttgctggcatcatacagggattctgtctcttacttttgtaagccacttaacaattgacagttatcttggcaacagccaagatattcaaaatttcaaaaaattcaaaaaattcaaaaaaggctatctttccttagtcttccccgtagcttgaggtgctctgcatatctttggacagatacttgttgatcaactgatccaattactccagctttggattttgccaaaattatttacaaatgctgccctctctattttgagacaatgcacaatggagagagaacaggcttccaagtaaggcaaggccaggtttaaatcctggcagagccaattaccagctgcagaaagttgggaaacttaactccccagaacttgaattttctcctctgtaaaatgagcataacagcacctactccatcacttcactgacatgattaagtggtactgcccatgcaagaacctgccatcttacagacttatcttcagtatatgttttacatttctacaccaaacaacatagaaaaggattttagtaaaaaagacattcgttgtcaccacttatagtctataccatagcattaagtacaatttcaaggagaaatgttttggaaggagattcatctgcccactaaaatgttaggaatccagaatgatctacttggctagatgatgtgctcacagttcagtactggacagttaggggtatcccagggcaattagtatgtgcttaaagtactcacggtcacctttggagctttttccccaggcaaagagtgacccagctggagtgcccacccctgacaagcactgacctgtagactcagaatccaaaggtgactgtagttttctcgtctgtctagtgagagtctgtgatagctttccttatctttaaagtctcttccagttggaacagtcctataacagctcatggttataggagaaacatagaacagagaaaagtctgccctgctgacttgcctacacctcacattgtagtagatgcccaaactggttccaagaatgaatgatataatgatgcagacattcattttcttgtctcttgggtctgcagcttaatcacctgaaattctctgtaccaagtgacctgctggcatgtccttcctacaagtgctgacttgtgcttggcaaggagactggtttaagatcttcctcagttcaaatgcaaatagtggagataataatagctaacagttgttgagtatttaccatgtgtcagatagtttccagaacttggcacatgtcagttgattcagtccttacaccctgaggtaaggatcactgttttcatatcctatactaatataatagtacttatgttttcctagttgcactgagccactaatggaacttctaattgacccgtcctttttcaacggttgggaatactctcctctgacttcctttaaaaaagccatgtaaaaggacccaagtagaatttcagctcatgatcttggccttatttagcatgacgctcagatttatgtctcttggacttcacagatggatgtgagaaagaactcctgctctacctgctgaaaaggttcagtatgctcatgtagatttactgaccccagtactttcaggggcttctccaggggatatcttccccacctcaaccctagtttctggctggatgctcccaggagctttgtggctgatagacagcactagagcaaaggagcccaggaggtcttctggctgcctctctcatcatatcagtcttactctcttttactcttttcttggtgtgtattcatgtatctgctttcacaggcagccgggtccagggtcaccactacacctggacccaatctttacatctcagcttctagggataatgggactctctccccatctctacttgggaaaaccccaaagaagggctctgattggttacagctggcacctgtgcccttccctggaccaatcacaatggctaagaaactgagggaccatttttggttcagcacaggccatgtctccacttttgatcaatttctgcagccaggggattggggtcacatcagaggatagcagcccccattgatgagaaagctagaagggcagtgggggctaggtgtacccacgaaaagagagatcaagttccaaaagacagaacggataaatgagtgaacagaataacatggtgagacatgtaaatgttggtgagtaaatgttggaggagcagtgaaatggccttgtggggacatcaaaagcaaatggactgtgtcaatgtaggggggagagaggatacataagaggaaagacatgagagtcggtgatatggtttggctctgtatccccacccaagtctcactttgaattgtaattcccataatccccaagtgtcaagggcaggaccaggtggaggtaattgaatcatgggggcagttttccccatgctgttctcatgataatgagtgagtctcacaagatctgatggttttataagcacctggcatttgccctgctgtcactcattctctctcccgattccctgtgaagtggtgtcttccaccatgattgtagttttctcaggcctccccagccatgcggaactgtgagtcaatgaaacctcttttataaattacccagtcctgcgtatttccttatagcaatgtgaaaatggactaatacagtcagaattagtagaagtgagaagacagagcaagaagtgctggggccaacatcatgccctcaagaatcccatgaggaggtgggaagaaggctgaggcttatccaggccaattgacccaaacggccaggacaggataatgctagtgagcatctgggtttccacagcctggccctgccctgcagttctctatagcaaacccacgtgcctgaggggagatggttttcaagacagctgctaggggtgccagggagctcctgtgctcctcaagtgcgttctgatcctgtctccatcctcctccaccctgttccccctgctctttggggcatggtggttggtcatgcttccctctcccagcataattccagaaaattccccaccaccattttgccacaagctggtgaagggacattaatgaggtcgttatagggcctgctgcattttcggaacagaactctgcacatgagtctaactgccaagtgagctgatggagaacaccatggctttccctgaaaggctctggcattagtgcccaaacactctcacttcctcaaggtcccctgtgtttttgaacccagggcccctgtgtttttgaaaatgtgaaatgataagtgagaaaatgaagtgaatcaagttttgtgggtccttggtgtctgggcatcaggcgctcagctgtgaaaggaaaatgctggtctttgagcacacaaaagtcatctgacagagttagaaagaaggggcttttcaccacttcagggcagtaaattgaactttgaaaagggcacctttccttctgggaggactgatttgtacagccgttatttctgagtgatataaagatggtcttagagatcttcaatgtccggctcctggcccatcacctgcttagggggtggtaggtagtgtagacagcaaactgcttgctggcctctatacaggacatccctacatggtaggtagtgtggacagcaagctgctcattggcctctgcacccgacacccccatacagtaggtagtgtagacaccaagcaactcattggtctctgcacctagcacccctacatggtaggcagtgtgaacaacaagctgctcattggcctccccacctggcattcccacatggtaggtagtgtagacaccaagccactcattggcctctgcacccagcatccccacagggtaggtagtgtggacagcaatctgctcattggcctctgcacctggcaccctgacatggcaggtagtatagacactaagccactcattggtctctgcccctggcaccctcacagggtaggtagtgtagatagtaagctgctcgttggcctctgcacctggcatccccacagggtaggcaatatagacagcaagctgcttttgacctctgcatcctccctctccagtcctcaacttgtgactgcctgaggcactgtaaatcatgcccagagtcaagcgcatggtgagacaagtgcatacccgggggaagaagcctttggctgtggctttctgggatgcagagtggcctcccaggaaataaggctgattgcctccaggttggcaccccacatcccatacagatgttcccattccactgctgtgcttgtctccactgccacatcttccttgcccctccaccagcctgctgcccccttagcactctgtgacagctgtcctgttggtgaccccagacccacattcagtggagcatgggatgctgctgggcagccatcccaggtctggggatcaggcctccctcatcttgagaaacgttcctttactttcaaaactttgtaggaacatggcaccaaattttcgtctttgtatttttgcttggtttaaaaaatttttttcttctgtggaaaatgaacacacatgtaaacaaaaattatatattgggacataagcctgcccttcctcgccaaaaaacaaaacaaaaccacagatagatttggctgttcctgtctcagaagtatatttgtgaaacacttgtgaatgatttatatcccatgtaactccatacaaattttgttagcacatgtgagtaacttcttagcaccccaccaaaatgattactaataatagcctgattcaccaaaaacaaaccaaaacttatttccttccaagcaagagtcttccagatctcttgctttcttcctttacatttatccatcaattatgtctgtataaagtcagaacaactgatggtttggatctgtgtagtgggcaagttcagaggtctctgaatggaaaataatggaatgcctcgctgatccgagtgattgatttggcaataacacggtctctccgtgtagacgttgttaactcttgctgagggtaagaaggggagagagaggttgaattcggtcttaaactgaggaagctgttggctttgcatgtggccagctttgggtgggagggggatgttagtggctgggtttctgacgggatgttggggttttagttcaatacaagaaatacatattcctatggatttattatatttcactttttcaaatatgggaaacaaaatcaaagttaaccttaacaatttgtctttgctgaaacacagtgatgtgagaatcctcaagcactgaaaacagacatcgttctagaatttgcattttcttatctgggtgaatttaacttatttcgaagctcagagatatccaatgtaaatttaagagcagcaccacagcctgtacttcactttgatcatgctagtcctatctgaccgtgcatccactcaccttatctgtcaaacacctagttgtcaagttaggcgctctgtggtgttcaggtaggaaggttctatctgtaatctcagaaggagctggcaagacagctggggagagagaatgggacaagtgtccagagatctcttttgtctctgactgtagtaagtgccttaaaagttgaatgctgcagagatatgcagaaaagtaataccccagcccctacggtgtttcctagcaagggacaaactacctttgacctatatacctggcttccaaaccatgaggtaagagagagagggtgccgacaacgaacatttccttacttttctaaaccagaagagatttcattacttggaaaaatctagaaacagttcctggaggagaggcctcactgttttttttttttttttttttttaagaatgaatttatttagtagaatgaatgaatttagtagaatttcagctactagaggtaagtccagctccaaggaagtgtgtcagcagaggaagaagaacgatgagagtgtccagggttctgccaggcatctggagggatggatggaagatgaacttaagggctcgggtggagggccctgggtgagggctcagcactgggccgacagcagcctcagggtgcatttggataccgacggactgttttttcatcacatatgagtgacaggggagtttagatggatgggttaaaagcaaagccatgtattctctgagtgggaagcaggccggatcctgagagttcgtaatcattgagatttcacatcgcatacctgcagccatgtttcagacaagattgtgcacccactcctgggtgaggcagcttttgaaaccaagctggaagcctttagccttcctgctgtctcaccaagctaaggatgggctgacctctgtatgggaccttcccttccttgcaccgtggaagcccatttctaattcacattctgacactgacaaactcggtgaccttggttacgttatctcatcttcttggaccccggcatcccacctaggggccggaagtaatgacggttgacacctcatagccacacacagggctagcacagactgctccagacttgctaggtgagggccctgtgcatctgaaagcaaaggaaggaagtgtggttaggactgcagttagcatggactcaatgcacagtccccactctgctaatcagatcatcacttcttagacctccagggaacagaaatatatttaatgtttatttgagatactttaagttaatagactttatttttaagagtagttttagagttacagaaaagtgagtggaaagtatgaaaagtccccatatccccatcacttacccatctacccccgttttccctgttaacatcttatattagtgtggtacatttattacgattgatgaacaaataatgatgcattattattaactcaactttatagttcatattagggtttattcttggtgtatagttctgtggggtttgccaaatgcataatgtcctgtatccatcattactgtatcctacaaaattgtttaattgccctaaaaatcctcagtgctctgctaatccatccctccctctcactgacccctggaaaccactgattttttttctgtctctgataaaaatcataaaaccactgattttttttatgtgacatttcttccagaatgtcacatagttgacattatacagtatgcagcttttcagattggcttctttgacttagtaatatgtgtttaaagctcctctatatcattttgaggcttgatagcgcatttcttttcattgctgaataatattccattgtctgaatgtaccacaatttgtttattcattcacctactgaagaacatcttggtttcttccaagttttggcaattaagaataaggctgctatgaatatttatgtgtaggctgttgtgtggatataagttttcagctcatttaggtaaatatcaaggaacacaattgcctgatcaatcatatggtaaaagtatgcctagttttgtaataatctgctaagctatcttccaatatggctgtaccatttttcattcccaccagtaatgaataaaagtttctgttaccccacatcttcaccagcatttggtggtgtcagtcttttggattttggccactctaataggtgcatagttgtatctcattgttcttctaatttgtattttcctaatgacatatgatttggaatcttttcgtatgctcatttgtcatctgtacatcttctttgtcagagtgtctgttcagatcttttgctcactttttaattgggttgtttgcgtattgttgaatttaaagaattatttgtgtagattgcttactagttctttatcaaatatctgttttgcaaatatattcacccagtctgtggcttgtcttttcactctctgagcagtgtctttcacaaaacagttaatttaatgaagttcaatttatctattttttatttcttttattttgtatgttgcatctgaaaaatcatcaccaaacccaaggtcacctatattttctcttatgttatcttccagaggttttacagttttgcattttacttttggtctatgatccattttgagttaatttttgggaaaggtgtaatgtcagcatctatgttcattttcttttgcatatggatctaactttcccagcaccatttattaaatactgtcttttctctattgcattgcctttgataccttgtcagagatcaattgactatgtttgcatgggtctatttctaagctttctattgtgttccattagtctgtctttgctttcagaaatatcacattatcttgattaccatagccttgtaagagatgaagtcaggtagttttagtcctctgacttatttttctccaatagtgtgttggctcttctgggtcttttgccttactgtataaactctggaatcagcttgttcatatccacaaaattacttgctatgatattgattttagattgcattgaacccatagagcaagtcaggaaaaactgatatcctaacaatattgagtcttgctatccattaacatggaatgtctctcctttttttagttcttttttatttcttttatcagagttttatatttttatacagatcttatacatagtttattagatttatacttaattttttgttatttggtgctaatataaatggtattatgattttactttcatatttcaatcactcattgctggtagtaggaaagcaattgacttttgtaaattaaccttgtatcctacaaccttgctgtaattactttcaggagtttgttgttgttgttgttgattctttggaattttctacatagacaattctgaaacctgtaagaggacagtttcatttcttcttctccaatctccatgcctttcatttatttttcttgtcctattacattggataggacttttattatgatgttgaataggagtagtgagaggaaacatcattgccttactcctgctgatcttaggggaataatacctggtttctcacctttacttttactgttaaaccctccccataactggggagtgctctacccataattgccttggcatccactcttccttgtttaaggcttttctctagccatggataaggcccagcccataatgtggagaaagacaggagtgcttgagagttaataaagtatcttgtttcttaccattaatgttaccgtaggcttttgataggtgttttctgccaggttcccctctatccttagtttcctgagagttttttaaaatcataaattagtgttagattttgttaaatgctttttctgcatctattgataagtttatatgatttttcttctttaccctatggatgtgattaattacattaattgatttcaaatatcaatcccaccttgcataactagaacaaatatcacctggtcatggcgtataatttttatatacctcattggatttgatttgctgatattttgttgaggatttttttgcatctatgttcatgagacatattagtctgtagttttcctttcatgtaatttatctggtttggtactggagtaatgttggccttagagaatgggttaggaagtattcccgctgcttcatcttctggaagacattgtacagaattgatgtaatttcttccttaaaggcttggtataatttactagtgaactcatctgggcctggttttcttttagtaaattattaattgctaattaaatttatttaatgatgtaggcttattcaggttatatatttctccttatttgaatttggtagactttgtctttcaaagaattggcccatatcatctaggttatcaaatttctgggtataggttgtcataatagtcctttattaacctttcaatgtcaatgcaataagtagtgatggtcccactttcatttctgatgttagtaatttgtgtcttcttttatttttctttttacctggcttgatcaattttattgtccttttaaaagaactatctttttgttttgctgattttatctatttttttaacctttttagtttcattgatttctgctctaatttttattttttttcttctgcttactttggatctaatcggctttttgttgttgttgttgttgttgttgttgtttttactttcctaaagtagatgcttaggttattgattttggatctctttttttctgatacgtgcattcactgtaagcactattttctgtgtctcacacgttttgatacatttaacttttatttttattttatttgagaaagttttaaaaatacaaagataacacactctgtataaccaccaaccagaactgacctttttcatgaccttatatctgcttcatctctttatagtaaaatccagtacagcgttacacataatatggatcttggcttccaccatcattagtctgcatcattcctcaccccttatttctaaatataaccactggcttgaagttagtgtgttcttttcaacccaattacttctactgatttgggttacaaccttaattactcctacatcaacaatgtggacctcaggaagctggaaaggatagcagtataataaaagatagtagcagcagaattcatagatatctgggccagaatgcatggatttgtatttatgcacaatgcatctgtcttagtttgaagtttcttagaagcagactcagggtcagttatttaaggcaaatagtttatttggcagtgcagaacagggaattggaatgtaagacgaggaagggaagaactctgagaaaaagtacattatcaagaaagttatcactttggacaactggagcttaatccgtcttgaaactctgggaggcagcgtagagcacacatggggaagtgggatattcatccgcaacacccatcagccattagttaagagcagacaacaggtgcattgaacccctggtatttatggacatagacaaagtcagctctgacagccaggaagtgcccttgagaggggaggtataggtcctcacatgcagaaatcagacagatgggtgctgacatggtcaaggtgaggagatgtgggcagtccaccaacgacatctgcccaaacctcttattaaaaattccttttctgagatttagcttatttagtaggtatattaaaagaataaaaagtaagagcactatccttactgactacatgctgtgtaccaggtaccggcatctcattctatcctcacagtaaccctttaggaaactgttgttacctttatcttcattgtccaaatgaggcccgtaggggttcactccttaccagtggccagtgccagcaccagaactctgactcatctgcccaggaccccaagttgctgctcatagagtgtggcttcagtaacccttaagaacattcaggaagggaaaggctgtaatggcaaagaaagcttattttgagtcaacttttagagggcaatgtataatgagttctgggagccttttaattaaacatggaaaagcacgagaggttgaaagcaagctgcttaaatgggaaagctaatatttacagatttaaaaaccatgtaaaagtctgaaaatccaggtctctcattaggtgtgatataattactgaatttccatttcctaacagtaaggaaaaagatgttaattctccatccatggattgcatttaagcaggtcttggatatagcctctggctgaagcctgttgtcaagggatttatctttggactttttaatggaagcaagcgttcggggaaattgttctgtaaaggatggcgttactcttattctctgtattcaggtgacttggatgagaagtttgggcagtgaatgtcagaaagggaaagtgctctttatgtgaccttgactcattcttccagaatgtctgcctacagggaaaacacctaggctaaaaacagagacctcagctttgccactagccagctgtgggactttggacaagtctgtagacttctccaaatttagagtgacttttggtgaggtcctgttcagctctgttaattgtacatggctgtaagtgaacctgtgagcaatggagcctctgccaaaaggctttcgcgtgcacctgcagtgctcgtcgtcagctgcagcccatgtctgccaccagattatcccactttgtgtcattaaatggatttccccttggcattaggcctaacacttcactgtggtccccagcatctctcatatgacttggatgagggcactaaaagcatacacatccactttatggatcccacaaagctggagcaatgagcagaaagtaccttgtttagaaagaaatggaacctggacaaacccaagatagatttgagtatcatctgccccacaccagccctgtgaccttgaccaaattcatttgatctccttgagcctcagattctttatctgtgaaatctgggaatacttacctaggagggtgggtgtaaaaatgaaatgagataatgaatccaaatgcaagaaaatggccaatgtagtcagttctcaatgccctcctctggcaaacggggaagggagcaggctcagtggtgagggacgggcgtggtgtcaaattcctgttctggagggaaagaagggtgcctagtgttgtttgctctggagaatgagcattttaggtggctagtccgtctactggaaggaagggaatactgaatggacaggtttgcagagccccaagcagtacgactagggcctgaacaggtgcagttatgggaggcaaagtgttgttcaatagaataaagtggtttttttgccttaaaaaatggcgacacatatacacacacacaaaataaaataaaacaaaacaaataaatagaaacaggaagatggcaggtttaccatcattggaagtatttaggttatgctgggcacaattttctggcagtggtgttgagagaattcaagcacatcttgatggggtgcgatgatggttgttcctctgtgaagctataccaggatgccccatagatagatggtctgcttgctcctttgagccccactatgcttttggaagagacctgtttctgcacttgggactccttagtgaacttaatttctggggtagacttaatccaccttcagatctccagtggttatcacagagtgggtacttcgtgaaggctgtaattaatgaatgaatgcatacatgcgtgaatgaatgtagggttggaaggcagggacatatgacttcttaggtccctctgaccccagactttcatcgtttcatgaacaaaatgagctcgctcttcccagaactgacctgtggatttagcttttccggccttagctggttctaggttctgggggaaccccacagttccagtcatcccttcctcccaaaatgccggatccaaggttttcactgcccctcttgcacatgccaggatggctagacctggtctccaaaccctcaacggtagttcagagccagacacagtgctggaccccatgatctgcgattattttcgcattactaagaacattgttgatattgttaatagctactatgtatcgggtacttatatacacaagtcacaagtggttactttgcatactctgtcttttaattccggtaaccaactgtaagatagtctttataattcacatttttcaatgtgcaaacacaaccttgagtttcagagaaggtcaatggctgattccaaatgcaagcctcgtccgcctgacttcaacaccgtgttttcccaggtgtcacacgatttctctgaaccctcgaatcacagcgtccaacagttaccatttgtccttttctccccagaagtagtcttgagtggtttccctagtcaacattgtatcccagtgtgtgtgtccatggtgaataggatgaggctcccacagtcatggctggaggtatgagactgggttcaagctaccttttggtcaaacctgggccgcaccattcagcagtatattattctgacatccctgttttcccctttgtatggtgtggatgacacttgtgccagtcttcccagaaaatggtcaaagagtcaatgagacaaaccatgcaaagccacttagcacagtcctggcccctactcaaccctccataaattattaggatttgagagaaagcagaaggctgtaaagccattttctcctctcctactaataaaggagagaaaaccacactttgtgggcagggaaagtgcaactgaacagcagccattcagcccctcctggatgtgcaccctgggatggacacatgtagggacctgcctgttttgttcaggagtcatttattaatgaagtgggcaagaaaaagaagtgagtgggcagggagagggaggcaggaaatgggaagggcccatcaaggggcaacatccagggactccatggcggtagaactggatgaaatgcctctcagagttacgtctctgcagtggtggctgcaggcagagttctctaccacccccgatccttggtggctgagggccagctcccctgcattcccagggactgagcagctttgcgaggctttggagagagctccgaggcaggaaagctgagagctgctgctggcactgacagtgggattctgccccagatgtgggatgtgcctcacagccacagtgaaataaagggtcttcctgccccacgtggcgcccaagctctggggccgaagacacacatttccaggaagatcaacctgacagagtcctaggctggggcttgaatcaggaatttagaaaatgccttgacctctggcaggaaaataaaagttctcaagtcttgccagccacagtgctcagcccagtgggatgtccaggcctatggctcttgagctagggtcctccatcttttcctctctttgagcttgaacatcccactaattcaaaaggggctggcagatgagatgaatgagaacttcttcctgggcagtcatgtttgcaagtcttggacttaaaccacatgccttggagctttaggggaagaggaggaataacttgctacagtaagttctctgataggaacctcatcttcccccctgttctgtatctaggggtccaaaccccagcccttgaagggctcccaatagagtgttcattccagatacgctttatcttcaaactttttagaaaggagcattaagtagaaaataaggggaaataaatacctttcttttttaatgaactttgcactcatttatgcatgcattcattcagtattctcatttttttcaagaaacagagctatggtgtccagacctcaaggcattgacagtctggggagagagaagcagaagatgtgcatcactttggaatgggtcaacacaaaacatcaaccataggtgccaagtgagagcacggtgattcagaggagttgggtctctacaagttaatgtggtcatagcatactccttttctttggctcataagaagttaggtgagaaagcttcagacaacatgatggcagtcctctccacagacagtaaactggacttgcttccaacagtcagacagtggtgaaccagcaactttcaaactccagacagctctcatgtaggatggggttgcatccctggcacttgttacactttctttctgttctcacttccaatgagattctcattctcgtttcatctccccagccctgatcatgagacactgtgatatttactgtggggaggaggaggtggcagaggggagggaggttggaggggtgtgggcagaggaagtcttccctctgtgcaacgtcacgtgtcatgttctcatcacacagttgttacctttgcacctgcccagtccccctcacaatatgctaatttcttgaggatagtggccacctttcctgagacatcaccagctcatagagtgtttttgtgcacacttaaaaggtgcccccttatgatgatcacagccttgtgggcactggcttagtgaatagatgataccttgattcaaatttataaaacagtgggctgggttcgatggctcacacctgtaatcccagcactttgggaggtcgagatgggtggatcacttgaggtcaggagtttgagagtagcctggccaacatggtgaaaccccatctctactaaaaatagaaaaattagccgggcacgttggctcacacctgtagccccagctactaaggagactgaggcagaagaatcacttgaacctgggaagtggaagtttgcagtgagctgagattgcaccactgcactccagcctgggtgacagagcgagactctgtttcaaaaaaaaaggaagaaaacacatttttaagactacttctggggttttgttaatgctccattatgtgacccaggtgctgagtacatggttgtgttcagtttgtgaagatttatggaacttatgatttatgtatttttcttgtatgtatgtaatacttcagtgaaatttacagaaagatcaaaggtaaaagaaaacacatattttaaaatattccttcctccagcttggcttggcaagaggagctagtggcaggatatcagcacccagttgcctcttcagtcaaaggtccttgggcattgcacatcctacacaactgtgtatgactattctcgcctgaatcaacatcttacgtctctggggttgggggtttctgtaacagtccttggccccggtgggctttcttatcagtcgctatccacttggtccattcgtcatcatgttgagcctctgtagccctttgagcggagccaatctttatctccttcattgctgacgataagtctgctatgtggcacagtgcagagatgacttgtgccaactcatgagttttgttacttgaactagtcctctgtttttgcaagagtgaatgaatgaaaggttgactggcagctccctgtcatgaagatgttttgaatgttggctgcaaaggcaggtaggactggaagattctcaaggtcatcagaaaggtcacattttcagctgccaataaataactttcaagtggtttcttacagactctgtctcttcctggtgttgtgttcctcttgcctcttctctgcatgcctgccttgggagtgcaccacacagtcatgtcatgcgctggcacctcagatcccaggccatccaaagggaatcaacttggtctctgtttttttcccctagcagtgctagaaatgagctttcagccccaataaagtgaaagaaggaaatgtttaccaagagcctccctccccatcccgtttgctttccttgacttgcttcagtctgtccacatgttataaaacaggattctctctgtggctattttcagaagctcagaccacatctcattacagcgcgagaacataattcaaaagaagcccagctctgctcctgggaaacgttgcgtgtgatagatgaggcgcttaaggcttatcccacaagtgcagtagtgctttttcaaccacagaccaacatttgagaagccaagaggaagacgtggtatactttttaaagaacagggctagaatttaccaagggggagaggttaggttcacatcaaaatctactatctagccgtcaggctccgagcagtatttctgtcctaattattacaacttgttaatggcaaatttagaaaaatgaacagtaggtggtcaatgtgggatcctgtgggggatgtgtgtgtgtgtgtgtgtgtgtgtgtgtgtgtgtgtgtgtgtgtgtgttggggaagtaaggtggtggggaggagagtccttagagaaaggaagggagaatgtgagagtgatggggtacactgggacccttaactgggaaagactgaggcacttggtggagttggaaatagtcagagggaagaagctgacccttctataagaggcctgtggggacattatgttccacccttcatagagcatcatacaggggtcctgggtgaatcattctaggccagagaggtaattgtgctatagatgggatacagctggtatattagcaactgattgaaaacagcttcagcaaggtgatttatggttgggcccagtggctcaaagtgctgtaatctcagcactttgggagacaaaggcaggaggatcagttgaggccaggagtttaagcccagcctgggcaacataacaagaccccatctctacaaaaaataataatactaataataaataaaaataaaaatattagccacctgtaccaggcgcggtggctcacgcctataatcccagcactttgggaggccgaggtgggtggatcacaaggtcaggagttcaagaccagcgtggccaagatggtgaaaccccatctctactaacaatacaaaaatttgcctgcgtggtggcgggcgcctgtaatcccagctactcaggagactgaggcaaagaattccttgaacctaggaggcagaggttgcagtgacccgagatcgcaccactgcactccagcctgggtgacagagcgagactctgcctcgaacaacaacaacaacaacaaattagccagttgtgatggtacaggcctgtactccagctactcaggtgactgaggcaggaggattgtttgagcccaggagtttgaggctacagtaaactatgatcatgatcatgccactgcctccagcctgggtggcagagtcagaccctgcccctcaaaaaaagtgtgatttatggctttggtgggaggattctctataatggcatgtctgcacttgaccccaacaacaccctgatctggctctttgatgaggagaatgtattggtggagacaaggaacatactgttaaccaccagagtctcttgggagcctgaccaagctctggaggtccttgacttctggcctcaggaggaaatttgccaactttccaaagacacatgagaagtggggcgggagtggccgatggagcctggagacagatggtcagtgttgaagttctacttgaggcatattcacaagatttgctttagatactcccaatgtccttccattgccataggctctgctcagacctgtgcgcccaccccacctttcctttctgcagcactctagcatggtgtcacccccattggagctggctccctctccccagatcacttgcagggcctgcccactgtgagaacaacgaggacatcaaaacacacagaggcacaggagagggctttgggggcttagggtgttcccaggctgcccaggctgcctcaaaaaagactgaaaatacacgcaaagtcttcatttactgcaagcgtatgagctaaacagcgccaacactgctgacagagcggtttttccactttacaagctgctatcttcagatgctaatgaattattccttgaagcctgaccagcctagagatactcccatctcagagttcaggaggcagacatgctgggggttaagaagcagtgctcagagccagtgatttagaggcgggtctgatgtaattgaatatttatggcccatggtgtggggagaggctgggcagctgggcttgcctgcttcctgcccatctaaggagtcaaactgtcatcagagtagccggggaagacccatcaatgttgtgttccccaacctctaaacctctgatccataatagatttaaggttcattgagggcatcttttgcactgataatttatttcctgatttttgataggtttttcaggctaatagttcaggacaatgaaatagatatttggtcttgatttcattgtaggatttgcagaatctgttatgctatcattttaggccagactgtgctatggatggtatacagctgctatgttagcaattggttggaaaccacttcaaaaatgtgattcatggcccaggcttggggggactctctataatgccatgtctgaacttgatcctaacaagtttgacatttttacaaatgatagagacttagaaaagttaagccataaagaacttcactgaagacataaaaggtgtaattatcacatttgcaaaagacccaagggttgtaggggtaaccacaaagtataatgaagaaccgggattttaggctatctgcacaacctgcagatgaatgagatgaaatgtaatcaggttaaatgcaaagtccctcatgtaagttcccagaaccaacaatgtaagtgcaggaagggtgaactctgtctaaagagcagttcctctagaaattgcttgtattttctagttttcatcagtgttagtatgatcagatatggctgagaatacacattctcagccactgagaattatagacagagtctaggtgatagtgtcactctcagaactccttcccgctcccttccctccctgtctcttgttctatgtctttttttatcagcaaggcagacttttagtgtcccccaatacctaaccctcatatttcatgcccattcccaagctaagcatttgcaagtagaatggagtcaccattattggttgatgagcaccatgctcggaggaggagaacagatcctgtgagcaaaagcgggaccctgttagagaggaggaaggggacagatggatcttctacagaaagtgaacaatttttgttttctttttccatagaccctgatatagtgttgagtcattggtgggttgattgatcttatgacgtttatttcttatcatcactattaggtaaccagataaacctaatggttagatggatgagatgtgaagttgtggcagatgctatcagtgcccttcccatgttgcctcagcctaccccagaggtcacctgtagatacttttcataaatgtatgtaaacagattcttgcatctgtctccctcatggtatcctttaaccatggaagtatgctcagcataaacatagagagagccgagaatgtctggaaaccaatacaccaggagcaatctttaatcagcgagagataagagtatagtagataaaccccagcctcttcacctcttcatggagcaataaaaggtaattcagcatcctctctcagagcatccccaggaggatcaagccctagctgatggaggtaatatgctcatgaatgtttgggccaccttcggggctctgtctcacttcctcactcccttactggtgcttcctcggatcacccccctaatttcacagtcgccttctgggggaagtcaaatgaagatggaggctaaataattagaactacttggttgagaggctaaaattataagtgtcagtataatatataattggttccttaagtaacgtttattaggcgactattgtgtacaaggaactgcaccctgtgttggatattttgacatagatgaatgagctatgagtttataatgtactggggaaggtaaggtaagtacatcccacccaggaagtcctctgtgctgccaggcagtgaaatctccacaagtcctatgtttgccctttttttttccatctgtatctgtaacacgtttcttaaagttgaaggaaagaccctttagaaaaagagatttgggccccacagttagggtagcctttggaggaacacttatggcaagagaaagaccttttattccttccaggaggagacatacaaccagatatggtttggctatgtctccaccaaaatctcatcttgaattgtattcccataattcccatgtgttgtgggagggacctggggagagataattgaatcgtgggggcagtttcccccatactgttctcgtggtagtgaataagtctcatgagatctgatggttttatcaggggtttctgcttttgcgtgttcctcattttctctttgcctgctgccatccatgtaagacgggacttgctcctccttgccttccaccaggattgtgaagcttccccagccatgtggaactgtaagtccaattaaacctcttcattttgtaaattgcccagtctttattggcagcgtgaaaatggactaatacacaacccattctttaaatctttccacattgctgtgagatggccaggatgtcagtaaccaggctgtcacttcactgcccctctacagctagcaatggctcagacatccactgtcaactcatgaatcccaaaccctagtcattgggcaagacaggctaacagggcaaggaagtgattgtgggtggtgacttcctgccttgggacagctttgacctgggagtcagtgcaacacaccagtcaccaccctgggcttattacactccccagtactcagtctggcaggtacagtgtacagtgtgttcacagagataaaagatgatactgtgactttgtccagaatctctgttaatgacttggaagcttaaatattagagcctgagctttctcttgggattaatataagaggaggcatgtgccagacatggctcctccgtgagctatctgatgctataaaaagaaaaactgcaaagggcatccagaaaaatgtctggacccaagaaaaaaatgaataatgtagtacttactgacctgtggcctgggatgtaaagggaaaccctaatggcgtaatcccagatccatcaactgtggagtctcatattttatgaccagtctttctagttgtggtgaggggggaaatgtggaggagggcagagtcttgctttcagctctgcatctcatttgctgcataacctggggcaaatcatgttaccaccctgagctgtaactttaaaatgaaggaattaggttgggtcattttcaaggaacattttctttttgcatgatacaaattcagactaaaacaaaaattatttatagtctacttacttttcactcaagatgaaaatgctttattgaattccataaaagaaaatagtatttttacaatttagatggtttattctactgaatagaaaaatgccaatgacaaagtcaacactgctttttagcctctgaagcattcactagctgggaatatttgagaagtggtacagtagtggaagctttctaatgttctgccttaaaactggatctctgggctgtcttatgaagccaagcaaatcctgtacatcctgacagccacaaatcactcatgggaccaaggccccaacctcaaattccatttgaggactcacattccctggatctgtggttctagcctgctgtgaatcccatctggaagaggttgagggagtcagctgtgagagctgagcagtccccagagaaagaactacacgtggcttctgcaggaattaccttcagcctgtggtaatcgagagtggcagctccagctatgaggttcagaggtggcaaagccttgggattaggtggccccaggtgaatcacagagcatctggaggaccgttgatgaattccttccccacctttttcctccagaaatttcaggttaaacttactctacagtttcataatgactgtttcatccatgacttctgcaagcctaggttggcagggcagggtgggagctacagtgctttgtaagttggaagttctgcttgagaatgtgttctggacttattctacatcctgcaaaaaagatggcttcaagctcccccctcacatgcacacacacacacacgtacgtctatgttcatgtgtgtgtttccgtattctttttattgttagtttcacttgaataatgtcagaggcaggctttgcacccaagcccttaagggtaggtatataaaaattattttttagcagactgtgtttttaaaagtttcagcagacttggtttttaaaattgtcgtaaatacaaaatttgccgtcttaaccaattttaagtgcacagttcagctgcattgagtacattcacattgtctgtgcaactgtcaccatcagctgtctccagaatccttttcatcttgcaaaactgaaactcatcaaacaacattaagtaatcactttccatttctccctcctccctagcccctggcaaccaccattccattttctgtgtgtatgaatttgactactctaggtacctcatataagtggaatcatacagtattagtctttttgtgactggctttcagttttatccgtattgtagcatgtctcagcaagtcctttctttctaaagaagaatattccattttatatacatcccacattttctttatcccagactgtatttttcacagttgactgagcagtctcttttttgttgttaatacataccctatggccatccattttttaaataagaattgtatttaattctgtggaagcagcagaaaaagtgattttttactgtgtgagcattctcaagtcccttactttgacggacttaagaattataacttgtaaaacttgagaacttaggactggttaacccacttgttttagcccattggagtggttaagatagtagtgttatagtcagatttgcttagaactcacttcccccctccaacatgagccctgggatcattgaaatattctgagattttggaggacttgagtctcagcacctacctgtggggactgcaagattgatatgtgtgatacatccttcttggttgacttgaattggttgagatacctggtttactgagctgctttcaatggaaaatatatacatacagatatattttaaagagatatttagcataaccctaaacatgttggccggtcttgttatagtcacaagtatcttctggtctccatttagtgcttccctaacatttcacctgccaccatgtgcctctaccccccttgcaatctaagcctccatcagataaaaccgtccagtatatgtggatggcccgtggtctcttgacctcccttgttagtaactggctcactactattcttcacatcttctggttgtggaaggaacaggaacttggacatgtgcctgacacattttgctttcaagttctgtatgcctttgagacatcacgtaaatgtttattgattttcattgcatagactgtattgacatactgcaatattcaatagaaccttcatactatggaaccttagggagtggttgttcctccatccaaatacagtgtgtgagctttgctaaatatttcataaatggtcaataaatacttcttttaatataatcagtgtgatgtctctctggaagctgaatataggtttgtgatctccaggtggcctgagagagactcagggaaacccttggggaatcttccttctgctggtatcactcaatcacctcccacccccatttggaccaaggctgagatggcaaatggcagacgagcctggggttctgcccttccttgcctctgctacctctcaaatatcaattgtgccgctataaatctcctggaggtcttgtcactttgcagattatgacacagtaggtctggagctaaacccaaggccctgcatttctaacaagctcctaggggatgctgatactgctggcccgtggaaagcaagatagaaaagaagtgggccagggtgagggtgaggcgagggatgcatccaggccacaaaatttagggaggcacctgctctcagagtcatccagctgctcttagggaggtttgccctcttggttggtgcaggtgtggacaggcacctaagcgtgggcgacttcttaaattttgcgcaccaggtacttcaggcacctctcactagtcctggctctgaaagaaagatatgggtccagggatttgaagtctgttgtgctgtttgccctgagttaccctataggccagtgcagtagatacctctgcctgtttgaccaactatgccccgtctttcctgctccctgagccatctgtagacagagacccgggctcatgtaaacgacccccacagcctaaccagatgtgggcaggattctctcacagctgagtccctgtagctgcccagatagtgcaatgttttaaaaagaagacttttagcatgatttcttctgcgtgctttgtggtgcaatgtgcatgatgtcctgtggcagcaagcagagaggatgcagagtgaattagcagtggggccatgactcaaacccaggcagtcccctgactcactgtgtcttaaccactctactcaactgttttatttggacgtgtttccctccggggtgtttatggtggataatcatgttctcttcagcatgttagccgtatggaaggagagactgcaaagcctcatactgcaggccctcccttgttcttttacctactttccctctcctctttgtaagtctattggcatttagtaaaattaagttacaggaaaaaaagaaaatagaaaagagctgttagccaacagttgaccaggcctcctccagttgtggactttctgggagggtccccatgagtgaggggaagggttttaattttcctggtagagtcatgtcctagagaagaccaggctttggttgttttaaagctaagcagttttattagccagcggagggattgggggcatcttcccatagcacattgaggtctccagtttctggaagagatcaaggtgaggctgacggacttccatatctggagaaagcccctgatcatctgccttttcagaggctgcttctcagctcaccctgtgtttgttggctttaaaaaagccaaacaagccttcagggaggagcttaagatgccaagcctgagttcactccatgttctctagatggtcttggataagtccctgtcctccaccttaagtttggattttgtcccaagaaagatttgattcttatttcctttaccagaagaaaaatgggaaaagaaaaagaaaaatatatatatacacacaaatatacatatacatatatgcacatatatacatatacacatacatgtacgcacatatacatatatgttcacacatattatgtatagtctgtatataatatgcatgcactgggcacttattattcgccagatacttgtctacgtccttttcttttcttttttttctttttttttttttttttttttgaggtggagtcttgctctgtcgcccaggctagagtgcagtggcacaatcttggctcactgcaacctccaccccctgggctcaagtgattcttccacctcagcctcccaggtagctgggataacaagtgcgcaccaccacacctggctaatttttgtatttttagtagagacgaggtttcaccatgttggccaggctggtctcgaactcctgacctcaagccatctgcccgcctctgcctccctaagtgctgaagttacaggagtgagccatcgtgcctggcccccaagtacttcatctacctattttgtttatgcctacaagcaatcttaagggaaagtataagcattttccccatttatgagaggttaagtaaagtctctcaggttaaacaaatattcagtggttggtcaaggatttgaattcaggcgttctgactccagggtcttaaatcatttttttctttccaacttttattttaggttcagggagtccgtgtacaggtatcttatccacctcccatcctgtacatgggtaagtgcatgttgcagaggtttggtgtacacattatctcgtgtcttaaatcttaaccattaaagcagtagttctcaaactgtagttcccctcagagccccctggagggactaggaaacccagatgactggactgctgtcctcagagcttctgattccgtgggtgtggggaggcagatggcgggtggctttctttcttttttttgctctctctgttgcccaggctggagtgcagtggcacgatctcggctcactgcaagctccacctcctgggttcacgccattctcctgcctcagcctccctagtagggactacgggcgcctgacaccacgcccggctaagctttctaacaggctcccaggggctgctgttgcctggggttggggcagggcacacacttgagaaccactgccctggacacaacccaaacttgggagaaagccccaaaactcagtgagcaacttaaccgacatggtgagacctgagtccccgctgggatgagcctgggagaggcgtccctttgcctctggtcacgtgcttgtgcgctcctggcttgatgatcatctgagagtccatgtggagtggagcttttgggcttctgtccagccagagagaggcccaggacacagccgaggcttctcattgccatcaccatgaagtcaatgagaccagagctgggaggtggtgagtgcagatggaaatgcattagcctggagggggcaccatagaccccagccctgccttccacatccctagcaatgcttttccacttagaaaaggtggggctggactatctatccctggcagtttggaatttgaattcaaatgtatcaaattttcacaggtcatagtttgagattctgtttctaagtgcctgtcccaccctgccttaagaaaatgtgtcttatccacctcctatctcttcactgcccggggtctggtcctgcccactctttccagtttcccaaggacttctatgtaagtttctttgttcagttagcaacatattattaacctcttttcctgtaaataaagagaaatattccatagctttcaataacggtgtgacatttacctgtgtggaccctttgtctttatttacttagacttctcttatgaggcactcacgtgactcctgttttctctctatcgtaaacacactgcatccttgtacattcatcttgccttataacaaattcctgggagcgtattcactgggtccagtaatgacagtatttccctagtgaggtactcaagggcgcaggtgcccaccagtctctcgatccgttaacatttcagtcttggtgaaataatgtcacaggctcccagaatccctccactgaaacacttattcctcaccactgtgtttttctattcgcaagtatcaaggcacaggtgagcttttgatgtcttttccatgacttgtttcaagacaggtccccgagtgaatgcagagcatgaatttgaggttgtcctaggatgtggatagagttgggtcatgggccatcagtcagttacagtgggaactgtggtgggctagcccggactcaagggcagaaagtccttaacagccctgactgaagagcacaggatgtgcacacaggagccctcttctgggccacatgtgcggattgagaaattcaggggaaaacctgacttgcggaggtggccagaaaatggaatcagggctgagaaagcagggacaggatgtaaagggctccccctggctaggctgaggcctcttgggaagggttcagcgcaggttgcactctccttgtcacctacagggctttcccaagattgctggggggcagccctggtagtgggtgggaggtggccctggtgctttttctgcctactcttaaagccctgttgaaaataaaaggcctttcatacagagcagcccagccctgaacacttgtgaaataccaagaatgaaatcgcagtgcactgccacctaggccattggaagttagtagtttttattcaccagtgaaaagatcagtagaacctggagaaaggtgtcatgaaaggctcttcatcacagcagctgtcaggccttgcccagccttctcgccaacactggctgccagaaatgggctttcctatgtcttcttagagctggaccagtgtctggctcagccactcctgccacacagctctggctcttcgacttctgggctctggctcatgacttccttgccttcctctgtgactgcccctcaggactcctgaggctctcagttcaagagcacatgcgtgcatattaatgcattcataccacacacatacgtgcgcacacgtgtgtacacacacacacatgcacacacacaaagccagtaagagaggttgtggatttgagcccattcacgtgcatgctcacaaagccaggaccgaagagagagctagagtcaattgggtaaggaatgatcacataaaactctctctgctttagatcaccaaacggtgaactcttcgtattctcactcatttgctgtcagtgattttttttcttcctgggcctggtgtctggggcctgtttgttagtacttaatgttgaaattagcaacaatcatagcacagtctacatacagagtacatttgtctcagcaatttaaagctccctttttagcaagcctttaagtatattgaggtcaagagaaaaaaaggagtgagtatgcccattttacaggttaagaaactgaggtctataaatgcaccatgattcccccttaccccagagtacgatcatgggtatactttggcatttgattttcctttatgtctccagccctagtcaatattgtctagcatcagttggcaggatactgcaggctgacagcagcgctgtccagtggatctttctggagtgataaaagcactctgtgcctgtaccatccagtatgatagcacttgccacatgtgtggctgtggagcactcaaaatgtggctggtgcaactgaaggctttatgtttaaattttacttaaatttaactcatttaaatttagatagccacatgtggccagtggctaccacactggacagaccacaggcagagagcatgagaaggaaaaagtccttaccagggcagatttcacggagcgatagccagctctcctcggctcatttacattggagatgccatcagggcagcaagttgggagggtggagaactgggaactcctgagaggcccaggggtctgaggacatcattgatagccaaggaagtggacacagtgcccagtcctctcagagaaacttcccatttggaagagttaccccagcagggctggagaatttttttttttttttttttatcaaaacacaaaaactcaagagactttttactaatgttctttcacgtggtttgctagaatgcacatttgtttgctacaatccagccaatgaacaatgaaatttatttaagatgcttcctgcaaaaaccagagttgatgatgtgccattatattagtgattctatagaacaggatccatgtgatcaactcatgcatgagtctgggggcttccgggaaaacaagttatgttatctctgcagaccaactgtggcctcctcttagcagacaaaattgatgtggctcagcaggttcccctttgtcatagatgtcagaaaatgtacaggcaaagtagctgcccaattgcactcagcagttcctctctgtgatgtaatagaatctcacgctactttctctgggcttgtgcttctaccactggaagcacattagaatcactggagagctttccaaataacacagtgaaacccaggcctcatcccaggataattaaaccagaatctctgcatgcagcctgagaaatgacatcttttaaagccctctaggagcttcttctgtgtatccagggtgagccagtcctctttaggtagtcattctccttgtctccccagctgtcttattttgtatttgatttccttgtgaactgcccaaggtccatttagaagtacactgggataaaccttaaataaaattctatagtgtgtttgttagacaaagtacaaatgtattttcactatgtagagaagtttggcttttcttgaatgtaggagtctaaataataaatctgaatagaatttctgtgaagtgtcaaataatgtcattatttcaggttgattcctcccatacctattccctgcaatagttcttttagccacaccgtctgattgccacaggaaaggatgctgcagacctctcctgagtggtgattaagtgaaatgcaccaaagaaatgaggacagtgagcaactaagatgcctgaagcaacactggaaagggagtcaggtctgagccacctctttttgcagccagtgtgcagtggaagtggctcgtgggtgttccatatttggattggagagcaaagcataatcccagcgctaagggaagcctcttatgcttctggaatagtgccccatacttccctgaaaaggtaataaaatatgtgcattcgctgattaggaacaaatgtcaaagcgtccaccatgatggaagtgtccgatttccatggctctgataagtcgccacaggatctcatgaatctttaatggctggcctatatttaggggctttcagtttctgagggtggtaaaaggtccacagagatgctattctcctagcacactggcttctgccaagaccggtgtctatttaaagcacctctcgtctttcgaatgtacagagattctgctgacaacaagaaactttcttgggcctgaaattagatgaaaagacctcccactcagaaagtgtttattaatttatttaaaaatatgatctggatcatccactacatgtcagggcttattctgggcacactgaggaataagacagggtccctgacctctgagcttgcattctagttaggggatacaggcactaggtaagaaaacaaataatcgaggtaatgacagtacagggtaattgctatgaaaagaataagccgggcaatcggatatcatttaagcacagcagtgacatgagcttatttgcattttgaaagatcactctagctgttggatgggaaaaatggattgtagggggataaaagcaaaagccgggaaatcaattaagaggccattgagtggtccagggaagagatggtagtggtgatagagatagaagagagcagatgtgcaacatatatttgagaatgaaagagaatgtgctggtgattgggacagaatcgcagaaagaaaagaagcaagaaaaactccaaacgggtggcttaaccacttggtggattgtgacagcatttcctgagacagagaagactgggttgtacatataaagaatagatttgggggaaatttcaagtgtacagtcatctaaattatccaagtatggctattatctaagggtagatatgcctagagtctggctagaggtcaagcctggagatactcactttggagacataagcttgtaagtggtactgaaagctagagctgacctggaaagacaactcagttagaaaatgagccctttgaggctaggcatggtggctcatgcctgtaatcctagcactttgagagcccgaggagtgtggatcacctgaggtcaggaagtcgagaccagcctggccaacatggtgaaaccccatctccactaaaaatacaaaaattagctgggcgtagtggtgcacgcctgtaatcccagctacttgtgaagctgaggaacgagaatagcttgaacctgggaggtggaggttgcagtgagctgagatcacaccactgcactccagcctgggtgacagagtgggaccctgtctcaaaaaaaaaaaaaaaagccacctgattcttcaccctgcagcatccaggagcagaggtaaccaagatggagcagccagtgaggtatgtcctagaaaccaggaagagagagagcttccataggaaagagtggtcaccagggaacatgaggttggagaagcatcattgagatgttcagcaccatggagcagacaagagcagtcttagagggaagttttagagtggaaaatggattggatgggtcaagagtgactgtaatgagaaagtggagttaagctttttcaattttgtctttgaaaactagagcacagatataagatggtagctgacagtggatactgaacaagatagggatctgtttgtaagataagagatatttctgaatagagattccgtagcatatttgtttgctgatggaaatgatggagtagaaagggagatgttaatgtggcaaggatgggggagctgtcagaggaaagctctcaaaaagccaagggggtacaggcctcagaatccgagttcaccaatacacttactaaagcagcagggacatttccattttaacagcaagcaggagagagtatgggtatagagaccaggaggctgggagatttggtggagaaggtgaaaatctcgtcactcctattttcttccaaatataaggcaaaattctgagtcaatagagatggcacattcaaggagagagaagaaagcatgaagcagtcacctctaagagcagggagcaaacatactaagaaaatgtggtctgattgcccagctctgctggtgcccgttggagcttccatggcctgtttaggctgaggtcagctagctcaggcttgttgtcttctctggccacataaattgctcggatatggcccagattaagtgtatgttgggtttaaccatggcctgaagtttagccagctaagtactacctgagatgagaggggcaaggaggtgagtgtatttgaaaagaagaaactggaaggatagacaatgggatcttgtgggcagccagtgcagtaaaagtaggaagggaacggtgggtaatgaaaagagggattggagccctgagggttctagagtgaatggcctggacagatgcaggagttcagagagatggatacttaacaccagcatgtctgatgtcatgacgtcgtttatgataacaaagggcaatgcttaggaggggcagagagcatgatcattaggaaaaatgaggtcacggctctggatggtcatctccatggatcctggcatcaccatgattgtgacagaagcggacggatgagcagagaccaagcctggggatgaaggatgtgcatggggcaggcaggagatgaggaggactgggaagggtggcgtaggaactggatgacaggaacttcaaagggtctgggactcgaacaaggagatggagaaatggtttggtggcagcagtggggagctttgatggaaattaaaattatatgcattgcttgagttttctcaccttttaggcttggagacactgttttagttagtactatagaagcttcttggagaacaacatgttcccaagccgcccctggtcaacctgccatactggagaaattccagcctgcccacagtgctaagcagggagcactccacgtagctgcatccactgttgggtagcccagagtcaatgttgcatgatgccttcatctgaggacatccagtagacatcagtgacctgaggaccagtccagctctgccagtacattcctgtgtgactttggacctgtgactccacctcagctcactgatttgcaaaatgagagtcaatgtacttcttggcttcctaaatccattctcgtgctagtcttccatgatgttacatgtctgggtcggggaagagtggcctgaggtctctatccattaagctttgggaaaaactagcaagcacaccatcactttatgaatattggcaaaggaaacggctgtggtcacatgcccattcaagcatgtcatcttgccaacctcgactcttcaaacctaaaattattcccatgcaagggtgacacccatgttcatactaaggtagggagtctgcccacatagacctcctccctgcaaacttagaggtgctctaggttcagccagggacccttgcttgagaaccgccggcaagctcaggtcgttcccacagttttaggactgtgcacaagtgtgtgaagatgccctgccacctgtgttcctgatcaattccttggcccattcagctctgcctgtcttgtcagccggttagagatttacactggagaccaaagtcctacccccaaatgttcgtgcaaatatcctttcttttccatctgctgtacaaccactcaatgtgtctgtttcccaaaagtgaagcagcctcaaatgtggctcagagatgacaatacccaaattagagataggaggctacacagatccctgagcagggctgttatctcagcaactccaggtataggattttagggccaactttttttctctgaaaagggggagggctgaaactgggaggccaggctgcactgcccaagaatcaacagagtgttcttctctctcccaagtatggtttgctcagaccttaaaatatggatgacatcagagtctggggaatggtcactcagatgcacagcattaagtctgtacgctgaacttctccccctcctttgcacatacactcgggtacatgtgcacacatgtacatacacgcacacacacacatagacatgactactattggctgatgcgctgacattaaccatgcaaaatgccagaaattagacgcagaagaagactttgacccactcatttctgtgtttctgtgcataacacaggacttggcaccaagtagatcacacacgtatgcatgttagttcattcctttattccccactcacatgttagtgatgtgaaactcacgtagacccagacatttagggaggtgcaggctagctgaggtgcaaaacacacacaatagctgtaacaccagtgtggtaagtaacataagggagatatcagcaaaacactgtgggggttcgaagcaggatagatttctcctaaaagaaggcatcaggagggcctcagagggagacggcacaaggttgagcatctaagattcaagccagcagactgagaaaggacaagtccccagcagagggtgtgtcaggggcttggagaacatgtctggggttctcaggttgctatgtggtattttgacgttttggggtagagatgtcttgagggcttgaagaagaagcagagtaagaggggagcccccgtgctggagctgtgagtgatgatctagtggaaaggccccttcagtgtttggcgttgctgtgcacctctcgtccatgagagatccccagatttgcccagtcttcgctctaaactgctgttttggtcagtccatgaatatggtcctgacagattcacagaaactgcctcagatttcagccttaacgaatatactatcaaaatcaatgtggctccaatttcttccttagggttcattgctaatgcatttctctttttgcactggaagctggaaagccagatgccgtctctgtgaatgtttctagatgttgaatgcatgtgtgttcaagggagtgggggcaggggtgtccagataaaatggctgggtgggagaagtccctatttctgtggtataaatacccccataatggccaatgtcaagacaaggacatttaacaactagcccataacatccctgcatgtttctacttggccctcagaagctggttcaggatggcttagcccatcactctgtcggggaagagtgggaatgaagaaaagaaagtgtgtagtagatagaggtggcaaagtttccttccctccataccctgatgtcccctgcagcactgtctataattagttgcttttttaattaaaaagaaaaagttttaactgaatggaggcagccaatttgtctccctatatccaaatttcaaacggttcctttaaaaaagagcaacatttgaaaatcgaaaatatgaaagtaatagtctgcaaatctctgcatgacagagagattattgctttacaaaggaatttgccatgtagttctttaaatcccaagttctcctggggttttaaaattattcaatttttgcaaatatttaatgtactgtttcttttaaaattcctgttgtgtagagcagaagttcttaatttggggtccacggatccctggaaggatccactggggtgggagtttaggaacttggtgaacgctgtgaagtggtgcacttgtgctttccctatggaaatggtgggtagctttcaacatatttttaaatagatccttcacttgaaaggtaatgacctatgtcacctgcctgggggccctgcgttatgcacataaaaaatgcatgggtggtcaactctaggggtccagtgaggcgttttaaaactgaaggcacatttaaagttggtgcagatttagtctatgtaatggccttctttaccttccagagaaactgggcttgccctgggatggcaggtaggatgtaggctttgctagcaagcctctgccacagatttttgataatgacaatgccagtgatgaggacacttcagcttcacacatgtggggaaggaaaccaagccagaagtcaagtgtgttacttccctcctccagccatgaggacgctctacctcattttcatctgtgaatctccagggtcatacccgtttccttcaccagaccttcgtgggaactctggaatagtttatgtcaatctcctggttaactaggggagccaagacctcctacactggctttcctgggaactgcaggattttctgttggatgaacgggattgtggacgtccccactaccgttgcctgaaatacaggggtgtgctgtagtgagtggggtaggaagagaaaccaccccattttcaatcatccacgttcacacccttgggcatgcggacttcctgggcccctagcagggttcccctgcggctgcatacagggccggcatcagcagtggtgggagctgcttgtaagaacgaggctgggaagggaacaaggggtgtttagcccattgaacagcacacttgctggccactgggcactggggttgctagctggggttcgggggccactgatcaaggctggatcagacatacagaggccgctatgcatctgataccagagttagtatttctggcctctcccctccttcctgaacccccagaaccctagctttgccactttcaaagccaaagatcttgctcctgagactcggaggtttagggttcttttatgtttgctattgttatccattcagcagaacacgaagcttgtatctgtgtggctcttcaggattttaaagcacatgttctttagaactctgtaaaacaagatagagattatttatttacattataaaggtaagaaaacagaggcttggggtttatggaattggctaagttcagaactctagattcctaactcacaatgcaccacactgcctgcccaggagagataataacaatgatgaaatagcagtagtggtggtggcggtggtaataacaacagcaatggcgggtaacccgccttgagcacttactggaactacgttaagccctttctgtagctttctttttttcatcctacaacaatctgtgacatacattaagtactttattcccatttctgaggtcatgtagctggggaattggggagccaggatctgaaccccggaagctgaattccagcctctgagctctctctggcttcatgaaccacctccttgtgtggtctgtgtagttcataccagactctctcagggacaatgctgtccacagagggtctggccactgctatgcagaggctgatgggctccagtaagcgcccctccaaggcagtgtaggtgagatcgggctggcccaggcctttgccccagtgacctctcactgtcctttgcaatcagatcagtccttaattctgtggtttggtctgcagagacttctaattaaaagatgggttttctaatgaacttttattaattcagcaatctgtctggatgctgaattgtcatttttgctaatagagaaaatggtttggtttattttccagaacagtgaaagtcactcaacttaattaaactgtcggaggagatgttctacttgtcttactcaacacgggtccctgagggagctcgcttcataaagcctgtcagccgcagtggcaattccagtctagcttttcttttgaagtcaggatggatttggtgtcagctacttctaaaattccctgtctggtctccagcagcaccagcctgaagcaaggcacagcaggacggtgtgcacattatatgacttcaggtgatcaagaaggccctgtgtcccccggggctcccccacttccctgtgcctggtatccagagaatggtggagggaggcttttaattcccaatgcaagaagactgcacaacccggattttaaaatctgatagcgagcacctgaaaagaaaattattaaaaattcagaactgttaaggaaaatactaactacatttggcaatacattaaaagaatcacctctcatgggcagttaggggtttatcctggtgataccaagactgattaatggtagaatatctaccagtgccatccatcatagagctgggtctccgtggagaaaaacactatgtgaaagaaaaatattttaggaacatttttattttttctgtattgtatgtatttagggggtgcaacaagatgttttgatatatgtgtatattaggggatgattaaatcaagctaattaacatattcatcacctcatgttggaatttttttgtgtgtgtggtaagaacatttaagatctactctcttaacaattttcaattgtacagcatctcattactaccatgctctacaacagatctttagaacatattcctcttaactgaaactttaaaccctttgaccaacattgccctatccatttctcactcccccagcccctggtaaccaccgttctattctctgcttctgtgaattcaacttttgaaaaactgtttgatgtggaaggaaagggtatcttctgatatgaaaaaggctctctgacactaacagttcacaatagaggtgaccaggaaatacacacgccccataaaaatcacatccaggctgggcgcggtggctcacgcctgtaatcccagcactttcggaggccgaggtgggaggatcacaaggtcaggagatcgaaaccatcctggctaacatggtgaaaccccatctttactaaaaatacaaaaaaattagccgggcgtggtggcggttgcctgtagtcacagctactcgggaggctgaggcaggagaatggcatgaaccagggaggtggagcttgcagtgagctgagatcgcgccactacactccagcctgggcaacagagtgagactctgtctcaagaaaaaaaaaaaaatcacatccaaggcagagaatggccaccattcccatttccatttaccgttttaaagggcccaatggatggctattgtaaatacaaagataactgctattatttgcagataatatgatagacctagaaaatcatgagaatctagtgataatctcttaaaattaataagaaagtgttaatgattgaacataagataaatatgcagaaactaatagttcttccagttactggacatgaccagttagaagatacactcaatcttttatttgcattataatgacaaaaaaagaaataataaaataaataggaattgactttaatcttgcacaacctatataaagaaaactattttaattagtatgtgttcttgggtgaaggatggaaacttatttttaaatcattttttcagtttaatttaaaaattccaaaaatttatttttagatttacctaaagacctgaaaatattctgatggagagcaacaaagaaacattttcttcctactctatacttggaaatgtgttttgggttttattaaaactacagcatcaaaccaaaccaatgagtagtgtgaaggagatagcccagaactgacattaggacttgagcctaatctataacaatgggaatagccttggccaaatcagacagaaggacagtttagcaaagcatgtgggaaaataggcaaatgacttgggaaaactcactgtggatgtaacatcctccttgatctcccattcttctgtcagacccacgcgatccactcccaggccggagagctagagtcctctgcctgcccaatgtcttccttgctggtgttgcagctggttatataaatgccttcagagattcattctggtgagcaattgatattaatctgagatgttggtagttaaaaataatatgtccgagcttgcctcaggtgtaaatcctggacttgatgaaaaacagaagtaaggccatccctgatgttcttactggttagcgaatgacttttcttcctgctgtgcaatattaaatgtaggcctcaatgtaaaatgcaaaaccataaaattcctggaaggtaacataggagaaaattaggtgactttaggtttggtgatgatcttttagatcaataccaaaaacatgatccatgaaaggaaaatttgctaagctggctttcattgaaattcaaaacctctgctctgtgtaagacaccatgaagagaataaaaagacaagccacagactaggagaaaaatcttggcaaagtacatgtctgataaaggactagcattcaaaatatgtaaaactatacaacatattgtcggagagagttaggtgaatgcttgaagatggttgcttcagaaaggagggaaatccagttgaaagtatggggccttccgtagcaaggatgtcagtgtccataattatgggaacccaggcagggctcctctcccaaagcacaaaaaattccagaggcatccaccagaggaggaacgatagcacagcaatgcctgcttgctcattaatcttctctccctctgattcttttgccctcctctctcttctgggcactataagggcattttcgagacttagaaacaaataataatgcaaggaaggtaagggctcgtttttcttgctgtgggtaaaccctacgggtgtcagctgagctggggtgggataaatgcaagacgaggactggtgcctagccatagtaaggactgtggtcctcactctgctgacagctgagctgacacagggctattaaccaggcagacgcaagcagaagagactgggaaaggaagtactccttctttataatggatccagcaggtggaactcctaggacctgccagatggcaacgaggtgaggaagagtggaggcactgctgaagcaagcaggagatgggcctccaaatttggaaactggctggaccctgggctgggtcaagcctgaggaggccaaaagattccagatcctctgttctgagcttgtgtggatgccactaacgtttacaggaataacaaatccaggagaaagaggcaggtgtttgcaactggtagaacctgcagggagtagatcgccaatttatttggaggcaagctaagtccaaaaaaggtgagattttaatagcagataaagtcattacccagaagtatttttgagctacaaaatttctcttccacagtgtaagtgtgtggaaggaactcaacagagagagatcagtgcttcatccagagttcagcatcacagacaccacagtccttggataggcagagagtttttggcttttggttcaactctggctcctcctggcagtgctatcctggcatgagggtgccatgtgccatgtacctaaagtgtcgatgacatcccaattaaggcaaatggcttgattatggtcttgctcctctgacaatttctcccatttgccagtcttacacgtgaatatagtatacactgtacctactgactctaccctgtgtgatacaaaaccattaagacttgatccaaaaaggaacaaaatggctactattgggttttgcaggtattagaagtgaatgaaagaatgggttctcatcttcacaaaggacagtctatactggaggataggaaactatccagaaatagaatgcccaggtccctggacatcaattccccctttcgaaagccatcaggaatcccatcctcgctgctagcaagaagtcctcagtcattctcatttattgccatctgtcaccttggttatttgcagggatttcatttagtgatctgaatccagagattgtccatcaaagtcaggagccaggagatgaccttgtgtccctggttctggtcctgtctcagccttcctgaaattgataactggcattcccctccctctactccctgggagaaatgaagtgcaggctcagagccttattgatttcccataacaactgatggatctttagggctctatttttatttcagaagtggccatctgacctgatcaggtctgtaaatgagctgataaaatgtttgctgctcttgttctcggcatgatctttcgtgctatggtttttttcttatatttgacatagagtatatccttggggtttaggtacatcctcttcttttgaggggagcttttctgaagtgtaacctcaaagacagtttttaaaaggggactgaaagaaccacagccccccatccattgtggtttgactaatccagcttacaaagctacagtgtgcccatgtgtggctgtgtccccagcaaccagcagtgtttctcagccccttttgggggaagggtgagcatttccaccaacaagaggagtctgggcccatgaccacactcgagagcttttatgctgtaaaagaaccctgcatgccttctgtgtccgatagataagtcgaggctcaccaggccattcaaactctgcccatctcattcatgttacatgatgaggaactgcaaaccaagtgcactttgaggacaggagttgtctcaagttcatctgcatccccaaaataaagcccagtgtctggcagtcaccccagtgtcaatcaactcctgttgactgaacaaaccagtagatggtcttgcttgtcagtggcaggtctccttcaaaagcgaagcattgttcttgttctcacacgggctgtggaactttctctttcctcctccacagaaagctgctctgctgtcccttagcatgtagcaggtctctgaggatggtgtggcattctcccaggcttctaacaggcccatgccatgctcagtgactgactacccctaagttgaaagatcagtgcattcagagagtcatagagtaccagttgtcttagcctttcatggctaacacacctccacatgcttccttcctgccaatgtccacttagtttcaccaccttcaccaggaatatctgactgtgggcgagccacaggttaattactcattgcccatcttccactttacccattttgcacacagctcttcttggctttgtaattgctccatatctgtatttacgagtgaaacttgcacctctagactggctttcctgacatctccttgaagtgtttcatacagatcttctgttctcccttctcgcagttacagaatgaaaaccatcctcttttctcatgctggcttggaatggcttccccaaggagcaaacccctgagtgaagattcaagtgtcagtggtttatttgggaggtgatcccaggaagtttggtgtgtgagtggggaagagagacaagagagggaaaggaataagattagctgtgtgagtgagtgagcagattgcttttgtgggcaaccaaagctttctccagctggagagctctgggagacagtaggggaggggaaggctgtgggttttaccctccagctcccatcagtcattggctggagctgcatcaggggcattaacccctagctctggtctgtcccattgtcccacatgttggatgaggaaaggacctcgacacttgcatgaggaccatgaatgcttaaggcacatggttgggacactgacagccccagctacactcaggttttgagaaccttgaaagaaaattttaaagggccttggcctcaatacccgctcattccagggacttgaacaagctgctgaaactcagtgagactcagtccttccctctatcaaaagggactgttgtgatgcatatttcatatagtggttgcaaaatccaggaaatgcatatgaggtgcttagtgctggcctggctaagaaagcacaaatacattagattcattaacaatgttataatcatactcgttttttgctacctcttttggactgaaatgtgttcagtatggtgtgatgaggtgtctgctgcatgcagcagaaagttgcagttcctaggagacagagcacttgggtgcctggccttaagatgagtgagctaagagaagtcatttcacctctctggggctgttttctcctttggactagaggagaggttctaatcattgatgattctgtgaaatggtcactcatacatataaatatcatattctacattgttctcttggcttcccaaacccactcttacccagctgagccatcctgcctttgggactatattacatcattacacacacagctgcctgaattcggggttaaaaagttgtgtccagtttgaggtgcactattgcagaaactagttggggtcttgcctaccatgttgcctacctgacatgtggtggcatcctctgccctagacttggttccatgcccttgtctgacaactagcccattcagctcctggaaccctgctcacagaggagaccagaacattctgtagactccatgtaccttattctcatggttgggagggcaactctgtgtgctgatcttgcagaaagggggaagttccccaaagaccagttggcttatctgagtccccttggccagtgaactcaatctaagagctgggtttcttgttcatgaatatttgggtcctgggacactgatccttactggttttattgtcctcctgaaaggctgaaacagcagaactgagtttagtaagcccagaaaaatccaatagaatttaacaaatacatattgactaccctatttaatacaaaacctctaaaaatactttgggttcttgacaggaacattattaatgctcatttctctcactgcccactgcatgcctggacttataaaatttgctgtgactgcacaatcatagaagtagtggtcattttggagcacattcagggcattgcgacaggaacttgggaaccaaatagtaatgagaaacagcctctgcccacgatgagtttccagtccagaggaagaaatagatagtataggcaacactctcaagagaaggtgctacattgctacgtcctggcttgtcagtgtgcccaaagtatgttgaagaagatattaaagttgtgataataataactattgagcagtgactatgtgctggacacccgttttagcacttcacacgtactagtgcttagtttatacagccctgtgaagtgtatgaggccacagccaccatcttagaaaaggaaattgaggcatatctggtctaaggttgtccagttggtaaatggtggagtcacagtggaaattcaggaggctggctttagactcaacagaaattccatcccatgaataggagaagaatctggcagagattcaggaaaattcacaatgactctgacttcagctgggtgcctggagaaacggtggtcccacaagtctacgaaaggactagtgggtctccaagctgggggagagcagagtgagtctgatttgggatgagcagagtttgatgttggcaggacagctggggaaagtgtccagggggattccctggagaagtcatgaaagccagatcagcatttcattccacctacagagagcccggggagtgctccccgagtgatcttcctacagagggcccttttctatggagtgagtgcaaggatttcccctctttggcccctccccttagggttcttctttgagctctagccttataatcttgggctctagacctagtggacacctccttctggaaaagccataggcttttcaaatgctacatgtccaaactgacctctagacccatctcccagacccagtcttcctcccgggttcccaccctgtgcacacatctccactgcagagccaagcacttcttcctctcacctggactccaccatagcccatgttgcttcattggcctccaatactctgtacacatgacagccagaatgatccttcaagaaattcagcctggttgtgcaccccctttttagaaatgcaaatggcttcccattgctctaagggtgaagaccaacacttcaacctgatcctcccagcccacctggcccacctggcctgcattgtctggcaccctctgcacctcacctcaccgtcattccttattctctttcctcaagcctcattctccttcttcagctgtcaacaccatgttgtcctccctcccccaggcttctctgggcttttcctcttcctggaacagtggtcctccacatctccctactttactccaaatctgcttgcccctctgccatgtaggccaagggaatcacagccatccttgcacaggtcttagactctctggggacatcttcctggtgcttatcaagttgaaactttgcattcattagtaaaattaaatcaccacttgctttcacactgcatggtaatctctcttgtgtccccagtgtccagccattggcaggcacataacatgtgctcaggaaattttatttgaataaatgagtgaatgattcaatgaatggagcaagcctgagatagcctcatttcctttcccattggaggattgttctttcttctgtgaggacagaacctataccttgctgaaatattctggacagtgagaacccttctgctgagattgtcctttagctcctcacttggtgggatctcagagaagaactcttggagacagtttgaggacaccacaagcacacggttcagtcaataggaggctctgcacctgtgtgtgctgaattcaattgcaaggtttatgattcagtgtgaagaccagcttagcagatgggaaggtggtgaatcacaaaaatggcccatggtgttgctgtggtctttccctttcagcacatgatgtagtcttgctggctttgctcacgtgacaacacactttctatctccactgcagggatataggcttgacagcaataagtaacctactaatgattagcttgtttgcttgtaattaatggctgctaaggccaggcacatcaggggcaatgatcagtcctgattcattgatcaaactgtcccactgaccatggactccagaaggcagctgcacttggtcaccaatagttttcctcctacccaccctatccctggggaagttgatactaactaacaatagcttcttagcagattttttactgagcttggctttccaaaacaactggggtcccttttgagaaaagggaccaaagaaagttatttgcaatggaaataaatggaaaataaattttgacagcagccagcctaggacacttgacacagaatttggctatcacatttcagtggattgtggggctgtggagtaattgtgtgtgtatgtggtaactaaacctaaatttagggtttagaatatttggcaagttcttaagggtaggtggcattttcaccagctgtgtctgctgtttttcttgccctgaggtttactgacattccaaatggagttgcctcctttgctgtggataccagagtcagggcaactgtgaacaggaaaaaagctactggatctacatggccaggaggctcagctaagggtcctgaggtctaagcctgtgtggagttgctgtgataatagcccagcttcttgcaactgtggggccaggttgggtccgtgctgctggtttctggctttcttcttgggtcacactggaagtcaaaatcccagagtaccaaagagaactgagggacctaagaacaaattctgtgatgagcttgagtatccatgaaagagacttccaggaactgaggtctggctggtgtttaacggttagctggaaataaaaaaatccaaatagaatcacccagcaattccactttgagatacgtatccaaaagaatgtatatatccaaaagcagggtcttgaagagatatttgcacacctatgttaatgggagcattagtcacggtagctgagaggtggactcaaatgtccaccaaaagataaatggataaataaaatgtggtaagggttgagtatcccttttcccaaatacttaggaccagaagtattttgaattttggattttttcaaatttgggaatatttgcgtatgcataatgaggtatcttggagatggggcccaattctaaacataaaattcatttatgttttatatgcaccttatacacgtagcctaaaggttattttttgtaaatttttaataattttgagcctgaaacaaagttttgattgcattttgactgcgacctgtcacatgaggtcaggtgtgagattttctacttgtggcatcatgttgacacaaaaaattttagatttggaagcatttcagatttcagatttttggattaaggatgctcaacttgtatatctgtacaaggaatattactcagtcttaaaaaggaaggaaattctgatgtatgttacacaacggatgagccttgaagacattatgctaagtgaaataaaccggtcacaaaaaggcaaatgctatatgagtccacttgggtgaagtctctagagtagtcaaatgcatagagacagaaagtagagtaggattgtcagggtccggggggaggcaggaatggggagttattcaatgggttaagagtttcagtcttccaagatgaaaatgttctgcctagtggctgcgcaaacaacatgaatatactttagactactgagctgttcatttaaaaagggttatgatgaaaaattttgtgctgtgtacatttttaccacaattaaaacgaaaaaattaaaactaactttaaaaataggtgtgtattttttcaggagactgaaagatactcagtctcctcggttataagcaaacgtgcaaattagtgctaccctggacagcatttttcttggaccatagtggcagaggatcaaaaagctacataattaaatgtgttggcaatagcatgggactcaggcactcactctcatgcatggctggtgggtgtgaaattggtataagccctttggatagtattttatttctgtcaattttttttaaatgtgcagcacttttacccatcaatttcccttctaggaatttatcttctaaatattcttgtccagatacacaaagaagtgtgcataggatgatgctgtagcccagtttgccaacactggcagcagcctcgttgtctgtcatggggccctgggtaagggagtcattccttgacacccagtaagtgaatgaggcagctggactgatgagtccatgtggaaagatttccaagatatgttaagtgaaaattgcagtatacataccactgtatgtaattagctactatttgtgtaaaaacaaaggaggctgtatttatgcctaagtgcaccattctcataggaaaacacctgctagggcctcgagagactgagtatcctggttgtatctgggccaggagttgggcgactggggacttcattccttcttatccttttgaaggctactttttgaaagcatgtgttatttatttgtaacaaatacatgcatatgtaatatatctattcaaacatacatacacttttttagagttggccttgatgatgaaggtcccagtcatactggcctcacagctccttgaagggcctctgatccacagctcctaaggaccaaacaaccaagattcacacgctcccaaaacacacctgctccaaggatcttactcacattgctagaatctcaacagaaacaaagtgccccccatgggagaaagagatccccctctagacaacgggaacaattacccattgtctatcattctgttgtcctgaaaacctgactgccttccatttctggggttagcccaggtggtccattgagggccttggaggaggccatcagtgggcactgttacctgcaaggggtctggtataggtgggtgcagggtcagctgcagtgtgggggtgtgggaggtaagtgggctggagggtaggtggagggaatttcagctccatctcatggccctggctcaggttcactcaccagcatgcatgcccccaccacatccctaggcttagcaagtccttgctgacccagggaaggagagtctcccttctagtccatggtactaagtagggaaacagaatttataaagactagaaataagtattaccatagtaaattctgttcctaaattgtaagaacagaaaaactgatcactgtttgccaaggattaggagttaactaccagagaattagggggtgatggaactgtggtgtgtcttgatggtaacagtggttgaatgaagaaatgaaagcctttgccaaaactcctagaacagtacaccaaaagtggtgaattttattgaatgtatgttttaaaaaagtaaatgaaaatttccgaaagaaagtatctgcctgctggtgagataaatgaggaaaataactgttatcatgtgactagtgtcagctcaggtttgggggccatggccccacacccaacccacaagctcaacttcagggacaaaagtatgtggttctcatttatctcctgtctccatacacagctccatcaacagcactgacctccacttcatgagggttatttttgtctcctgttttatccttgtatgtctcgtcaacccaatggcttaattttagggactataagtatctaagaaaagaggtgatgaggtatgtctcatgttgtggctgaagtggaaggatgtggattccacttatcttctgccaggcacccagaccctgcagaatcaataaagacgtgctactgcataggaagcctgggaattaaatacatcagatactgctcccatgggcttggacacaactttggtcaagttctgtctttgccatggagccctgcttctctggagggcagttagaggtacagacattggggcccgtcaaacctgggattggattctggttccaggtccttgaacacagttatttaaatgccttaaacctcagcctgtttgtttataaagtggggataattactttataagagtttggaagatctgttaggtgaatgtggagtgtcagctgtacccttatgactcttctttagcgtctcccatagagctgagtgctcagaacacaggagatgccaaattgatgcctcttgaattgaattaaatgccctgtaatatgataaggaaggactcagaggctggagaccccatgcgttaggaatctttgtttccttccaagagcacaaagagacctctctgttttcttaccaccttcattctctttctttttcccttcatatttcattgttttcatatttaccattccattttcctccctgtaccttaactaaatctgattgccttttcctgtaccagatcagtgcttctgaataataataataacaacaatagcactatacagatttccatagcaaaatgccttttgcctgatttggtaggaaaccagggctcagaggagacaaatgacacatctgtggtccccaagctaatacatatttggtggacccaaagctctctgaagaactgaatcccagcttattgcacaataatatcagtactagatgatatcaagaaattccatcttgactcaatcacagccactacacctagtcagtcactgtgagctgaggtgaagaaaaaggtctgtatgccacgctaatatcccagtgaatttacagagcaagccatagctactccattctagaaatatttgctgatccccaagatactgatgccactttgaggtcatgaagctttattccaagccttcttaaaatgaggcttctttatgattagctgctgcttccattttattgtcaaaattcctacagagttttgttttgtttggtttgtcctgatgaaccaatatatgtgggttgttttcttcttcaatttgtggccaaattgaaagatgtgtcaatgaccatctctgcatgttgatgttaccacatcccaaataggcccttatggacctccttccccagaagattgatggggctggtcaagagagactttctcgtaccaaacaagaagagaattggcatgcgctgggtagcgcattttattgttactgactctggcattttccccccattgcagctataatcatgggacctcaggcagtgctcagtcccctcagcagtactaggcagaggccagagggcaggtgccttggagcagggacttggccctctcatcccagctctgcttgcctctgcgcacatcaggattgcacctcctcttgcctgacttaatacttcataacctggactgacacgttaggatgggaatcctttatactggaaaacaaaacaaacagggcagtgcttcattatagagcctcatgtgtgaggttctgttctccctcagaccaagatctaggaattgccttctagaaagaaatgagaatgagagcccagctccatccagcctaacaaccttctggagggataaaacatgctgggactctcgactctccattactgtcaccaccaggaaatgcttcagttggaaaattggccaaactacatttcaacctagttaacagtgggcacaagtacaggttgggcatcccttatctgaaatacgcaggaccagaagtgtttcagatttttttttattttgaaatatttgcatatacgtaatgagatatcttgtgggtggtacccaatctaaatacaaaatttaattatgttttatatacaccttctacacaggccctgagggtaattttatacaatttcttaataattttgcacatgaaacaaagttagtgtacactgaacaatcagcaagcaaaagtgtcactgtctcagcccaccaatgtggcattatgtcactgatccaaagtcagattttggagcagttgggatttgggattttcggattagggatgttcaacctgtagattatttaagttgtatttactgagatcagtcacagagcagaaacccgcatacgtcttctttgcttttttcctttaatgcactcaggaaaggaaagccacccttggaatttctggggaagtcacctagcctaattcaatctatacattcagaactcctacagcctataatttctcaagagaaaagggttttgtcccataataatatggagaattgctagactctcaatccctatcacagggattatctcaatccccttgtaggtatgattgactcattggctatatgaggtttttatattctcagtgtatgtgggttttcatgtcttagaatcctgagttaagatcacaggttttaatggcaagcatctcattttattgtgtgttattttattttaattaacattgcaggttaaagcagcacatgactcaaaagtataaacatcatagtaatatatttgaagtaggctttgtttatagttgatgaatcatttgttcttggttcacaatttacatttactaaatgcctgcaatttgataagtactattctaaacattttcatatttctctcttttatggatttgtttcccaatttactttttcaaatgagcccaagggcctttgggacattccagtatatgaccagccaggaactacaatttgggggcacagaggggctgatcaggggaattttaactgttgttgagagcttcctagtggccctgaggatctgtgggtcccgaattgtctttggaacatcaaagacaaattatatatgttcagaaaacagttcagagcactgagtgtacagtataccacgtggcctttttagttgatggcccatatattaacctatggtgggtgcctctccctctggaatgtgccgttcttcactgttctgaataatggagttgaatgttgccccattttctttctgaatccagcactagatttagaggctctgggtaggaggaagtagaaactgtctttgggagtgtggaaagtttgtgtccttggtgtatctggttggggggatcctgaattgctcacctgtttctgtgtttgtaaacttccaaatactcccctggatcccacagatcttcctccttactcattgatggccagattggccatcagaactgttgccagttcattcaaattgtccttttgatccaaggccacatgtcctcccatctttcactctagatggtaatgagatggaaaccaatcttgtgcccaggggtagcatctctccaatacacagcccatggcccctagggaattgaaaaaatggctcctggtttattttcccaaaacagaaactctctcaggctcgtgagaaatctggcagttgaaaaatgtctcctgccatatacttcatccacaaagccaagagagaggcagtcagcacccaagagtcccactggcctcctttgttaccgaatcccctgactttctggagagagggatgcccaggagtttcccaagttaccatgtgcatcattaaccacctaaaatagcggctttaggtgcagtggtatttgaactactgaaaaatcctgacctggatgtctgctaaatatagtaattatgactcagtaattgatacagttagagctattattaagattgggatgttagggtgaagattttgccaaagacactctagtgttaaaaaataaacaccattcctcaatttggtagttccacacctcagacccaccttcctgagggatgtgggatttcatgtgctcttggtacacacatacaaaatcctggagaactgcctagggggcaaatggggacttatatctcccatccttgctctttgccatcccttgaaggttttaaaaatatgcatctgtagcccttgcatggaatgaatggctggcttgcaggaaacaattctttctccctgctcctccctcatggcaatctgtgccactgccactttctaatctctcattgcttctctgtttcttctcagcgagcagaaagtaatttattcatattttaaaatacggaacattcacaaaactcaactttgccttttcctcttttcccatgcactaatcacccagttatggcaacaaccatttgaagcatgtgaacttgccctttcattccttggaggggaggggtcctcactgccatccttgcatttagatgccagggatagcagcaccaaccttctttccccaggtccctcacctgagctcgtagttgtccagagaggggaagggctgtgcacccctccctgtcctctgaatatgcttctcattccggttcctcctggtcactgtgtttcctgcacattgaatcctccttccttgttacctgtctagtctgtaactaacctcttcaaagatggttctttcgacatgcttggttccctagcaccaatctgtgttgtctgctgtgttcctgagttggttgaacagaagtgtcatctgtcttccatgccccttagcacaatgacctcagggcagaaatgaccaacccttgtcctcgatggacaaaggttgcctgagcttccagtcaccctggcttaggcctttccaggctctgtcaccccaggcactgagtggcgctgccatcacattctggcaccccccatacctcctctaccctcctgctcatgtgtcagacacccctgcccctcctctgttcccaatgaggatgggctccccagaagtgctttcaagaggaggacttgtttgcaaatcactaaggacatgctgggaaaggagtgggagaggaaagaggaagggaaggaaccaaattgagggtgtctccccagtcaaaacactgcccgggaaggcttcatcttaatcccacaggtactcagtgtgaattctccctccaggatgtcccagccctgggcaagggcgctgggcttgcaaacaccttcctccatcagtgattagttaagggacctgggcagggcagcagtgtcattattgcccatgctcttccagaagtgctcaagggcccccccttcacccctcttcaaagagaaggtgcatgtgctggctgttacaaactggaggcacaccgaagcggggtgcagatgaaaaccagtggtgtgggcagatacccaggttgttcactgtgcactagatccgaaagttatctaccttttgataggaaactttgcaagtatttcaaacagagctttctggccttgacaaggccatggatattcttctttactatactctaaagcaaggccagatgcttgctttagagtactcaggacaacattgtagttaaaagcctgggctctggagtccaagaaaacagggttttagatttgtctctgccacttatgagtcatgtggccttgggcagattattttcctttctgaatcaaatctccacatctgtgcaatggtgacaactccacttatctgccagtgtgttcgaaggaccatttgagacaacgcatctgtagcctggcaccagcgttcagcccaccacacctgctcagtccatgggagttcttacagtcattcatttttcccattcaagaagcagaggattccaggaagttaatactgtggtagaatcccactcactatggacctttagccttttactcctgaggccagggatccagtgctttagtttcctgcatctcatatttacatgttcaccatatccacatactccctggagaattattatttcctgtatattttccttaaactcactttcaaaaactgtattttttgaagctaattttattatatctgtttcataaataagtgtggatatttttataataatattaaaatgatcattatataactattaacatttacaaagtttgttctcgtatggcctgtcctcatctacacatccctggaagcacaccaagcaccttccaggcatcctgtgtgtacttctcataccttaagagctatccagccatagcgatgggatttcaacagccctagggatttagaagcagttcagagtatggtatttctaatctttccaataatgttttatatgtctcactgccgatatctgactctgggaatggaattatttctggatcctgaggttgcttgtgaggctgctgtgtagctctctgaattaaatggttggcctggcctcgttgccatggtgacaggaatcagtgcaagccgaccaggtgaccagctggatggggaagcatcacagatgtgggccatttctttgtcagttatctcaatgactgtcatttccatccccttgagttggtcacatgagcagtcaccatctcagatcttatctctgacatagccggtgggagggcctgaagaccttggaagttggtctaggatgcataccttggaagacacacacaattcagtgatgtatttttaaaaagagtaagaaagataagcaaaccgggtgaacactgtctatttatttactgatgaatgcaacacctgttatagagttggtactccaaaattttaattaaatgagtgaatgaataaaccaagtactaacactgtactatataataatcatatgtatgcttcttcaaccagcatttattgactattttctgcattcttaggaccaggctgaggataaaagggtagaatagcctgaaaatgtgaagcagtcatcagatgtcagggggtgggtaagaggagagaatctgggtgctttcttagggaaagagaatggatcataaaatgggatcactggagctggagggtaagaatcttagttggggggatcagttaggctaagggcaagtcagggaaacacttctcaagccaatggccagttcatccccttccctgagagaatggcttagccctccacactccagaaacactgcaatgaggcagactttctagggtcgtgctgcagatggtccactatgctgcttgcctctttggttcctcacaggcctggtttggagggaaatgctctctctcgggtgtcttgctggacactgtatctcttggctccaacttccttggcctagcttgccgcattccaagtcaaaatagctcatgctccttccgggcggctccccagggcctggggtgcatagatctgcatggagggggagagggtctgtgactggagatccttcttttgatgggtatctctctgtgaggctcagcctcggccaccaggccccatgtgcccagcagagatgctgcctgtgttatctgagtacttagaccctgggtttgcccatctatagtccatacccacccaaataagtcatgcctgtggaaaactttttagacagttttagtccttgtgatgaaggagagcaaaatctctctccagaattgaaaatgcttcagcagagaagtactcttgcagtaaactggctccatctagcagatctacaaaattagtggagggaagctttgcaaacacgaatctttagggcatctcaatgaggatgcttggttctgtccagactcattgccttccaagtaatgaaatcatctgggaaacaaacttattaaaatataaaacccttctagaatccttcttcaagcttcaaagggagatttgggggaaggaaatactaccccattttaatgattgcaaagatgtttggggtgggagtttgggggtgcacattgtttttggtgtctaattcaaatttggttatgtgctgtaggtcagtttccagggtgcacagcctggactagggtcttcctgagcctggaatttgggacagaaggagctagacccactcatccagctttgggctgcagtgacttagagggattaagaggcaaatcttgctctggccatcccgaaaaggctagaggactcacctctgatgcattttacaattcaaagggatgccccattcctttggagacttagaacaaaagccaactgaagaggttgtctcgggttgggtccccaagacagagattcttgtgcaagtcattcattgttggagagatctccagagaaaaggagtgagagaaacaggatcaggcaggaaaggaggcaacaaaggagtggtgttggctgcagaccagcctcaggtggatcccaggagaccatggagtgtgaatggcaccacagagctgtcctgccttgaggcaggagctggcctttgtaccctagtgtctaccacccctcttggagtgaggacttaatcttctaggcatttctgggtgaggttgcatgcactggccaagtgcaactctggagaacttactcttagcctttatcaggagctggatgcatcagccccagaaagggtttctgagcgggcaccaacagcatctacaagacatagtcatgtggttgtcctgcctgtactttgcattggactggatgtacaagttcttgtcacctttacaaggagacatcattcatctgtctatgagaactccctttcctttccagccctttccttctcagcttttagacatgttttgtaaaagtaggggaaggggtggatacataagtgaatgtagctggtcagacatgaacgcctcgctctgtagagcatcgccagctgtggatgtagccgctcagctattcatccaggcttgttaaaatattagagcataaaaaggctgatttcattcgttgtatggcagtacagcttccctcaggaaaggcaaggctggccaaaatgtgtgtggtccataccttttgggtggatgatatttgcaagacttgactccctcggctgtgcccaatcttgccctgaccattcacttcacttcttgccttttctctagaacttccctttctgttatttggaaatggtcacagaaaagtacaatcttttccattctgaaacccaacttgccattttcttccataccatgtggttctaatatccacatcctccacagcaccccagatttcaggctgggcatcctgttgtcacctgagtctgcgcctgcttccaacacaccaatacatagccacacagtggattctgtttggctctttggatctgagtttccggcaaaaacaagattttttttaaaaacaatgtgacagaagaacatagaaatgtctggaacgtgttcaagccagtgaaaacactgagaagacactctccctgccgcctctcagtgcagacgagtcagacatgcctctgggacaccccggctccctttggctggcacagggaatggaaactttggccacgggtggttgtttctgtggcttctgcacttctggcctcacccgcttctcactgatgatttcgcagagtaagcctagtctagcatcagtccatcctcaacaccagccagccggtctccatgcagcaaggcccgataggcatgctggagtctcaacaggaaatgtgcttttccactgagcaaaaacagacactcaggagctgatgggctgtggagtgatgtgcatggttcactcaggaccctgtcacattaaaggagcatatgaagccatatccccacatagctcagggatgtggggaacaagttgctgtccatcgcccaccctccagcctgcactcctgtggttggattcccaatctctgtagcaatttattgcaggattcctttggaatgatcaagagaatgtttgtggaagaagcagcatttgtgtggctcctgagttagcctgggttgccagaacctgagcctggcatgagcattcccgtgaaagccatgttggacatgcttcttggaaaaactggtcagagagcacatagtgtgatcaggaaaaggtaggaggtcaagaagggcacggtgtcaagcagagtcccacagagaggaacttcagcacaaccgagccctgggtgctggctcctgagtgtagaagcactctgggagctggagttagcaaaatggtaaagggctttccagggaggaggacagaaccctgactgccagcttcagttccattatagcaactttcagaggagtttgtgggagcaataacagcaccaggcctgttcttccccagtgtctaaacttctttctgttgtaagctgagctcttttgcaagccccagtatcaactccttctgccttctccttgtgagttccaacacactaagtagacattagggtaccagccatttaccccatggggtaccagcgatttgccccatggccgtaaaatgtgcacatgataaaaaagggccctggggcatagaaagagtccctacaaaaggtgccaacatgctttccatcaggatgtatctcaggcaacaggagaatctgagtcagctcccagctcattcttagcccatgacaaatgttgagacacaagtagacatttccggcactcaaataaggcaagaactccaaaccagtccctttttgggtagaaggggctaggaccgtttcatctgaataggaagctctagttggagaaagatacttaccgcaaggcctgcagtgaggagcagaatcccagacgctatgtcctccggggtcatgtttctccagcccaaggcttagtaaaaggctaattaggaagttggccaattttagtctcgggtcccattttgggctctaatgtactgtgaaatgtaatgcaattccacatgttttgcagatgcttggtgcagtcatttctttgggaaaaaacaaggttagggtttgcacattttttcccctttgagcctggggagaaacgtgaactaaaccacgtctaatgttgatcctgaagaggctgctgtggtgtagaaggaaggacacttgcctcagaagatcaagtggatcttcttactttgtgaactgagcctcagtttcccactctgtgaagcacagagctctcgagttctcatgaggatcaggaaagagcatgcaatgggaacaatgatattaacatattaagagttgctactgtttctgctggagaacttggctgtttgttcaaggagaaatgctttaaagcagaggtccccattccccagaccatggaccagtaccaatccctggcctgttaggaactgggccacatagcaggaggggagtggtggatgagcaagtaaagcttcatccgtatttacagccactccccacggctcacgttaatacctgagctccacctcctgtcagatcagtggtggcattagattctcgtaggagcatgaaccttgttgtgaactgcacatgcgagggatctaggttgcacactcctcatgaaattctaatgcctgatgatctgtcactgtctctcatcacccccagatgggactggtctagttgcaggaaaaccagctcagggctcccactgattctacatggaggtgagttgtataattatttcattatatattacaaagtaataataatagaaataaagtacacaataaatgtaaatacttgaatcatccccaaaccacccttccccaccagtccatggaaaaattgtcttccacaaaactggtccctatgccaaaaaggttggggactgcagcattaaagagccacaacctcattcaaactctggatggctgtgcccctcccccacccccacaccttgtctctacttccctgtccacctggactgcctcctgcagtccttctctagggctccactcaagcctgatttgccctatgcagcctcactcactgtgctggctcatgctgacaccttccttcctgacctcacttcccactcactgtctgatccatattaatagatatcaattgttatcaatatggttatagctatggttatcagttcaggtgagataaatagtggcagattgcatcttcccaaaagaccacagcaagaactccaggacaacatactcttccagaatcttgtcctcccccaccaaaaatgaagagatagggtccacttcacctccctttaagactggttaaatctttgtaactgccatgaccagcagaagcagcggaaatgttttgcgtgacttcctatgccagatcataaaaggctgtatgatttcctcctggcactctcttggcgtgtgcacgtgcagctctgagccactatttgagaagtctccaagctgagaagaccacatggcaagaccacagacttggagaggccagggagccccagctgttccagctcccaggtgtttcagttcccctagcccagaggccagacaggcagtgagtgttggagccttcacatttccaggtccagccaccatatgattgcaattgtgtgagcagccaagtaaagaccacctacctgaggccggtcaacgcctaaaaatgtgagacataacaataaaatgttacagttgtcttaagccactatgtttgggatggttattatgcagatacatatacatatgtactatcttagttctggcagctttaagaaaataccatactgggtgggtttataaacacaggaatttatttcacacagttctggaagctagaagtctgagaactgggtgccagcatggttaagttctggcaagagccttcttctgggtgacggacctctgacttctccttgtattctcacgtgacagagagcagagaggggaaacaaactctctcatgactcttctagagacaaggtctctctccatcacccaggctggagtgcagtggttctatcctcccaccttagcctgctgagtagctgagaatacagttgcataccactatgccaagctaatttttcatgacttttataaggatactaatcttatttgtgagggctccaccctcatgacctaattacctcccaaagaccccatcgcactggggattaggatttcaacatatgaatttggggagtagggtattcagtccattacacacatacacctagatacttgcgtatgcatatgtttgtacatatgcacacacacatacatgcatacctatatttacatacatgtacacacatggatgctacatacatacatacatgtacacacatggattatacatacatacatgtttagggatgtagcctgatttcttcaatcatcctccagtttgtgcatttgtgtgtgtgtgtgtgctggaagttagcttcccagctgggctgtaaactcctgacatcaagactgtgctgaatactccctgttatcctccgccagctgaagaacgacatggtggatgtagcgactctgccctgaacccttgagttatattgatgaggaaatgtgtggtgcacacctgtgtccctgaaaagctcattacatgatgcaagtgggatcagagtcactttggtctttgaatctttctcaaggaacctgtatccttggaaagaaccatttacctgaaattgttgagaaaaagccactcgatttgcttctgtgtcgtagactcagtggaaggaaatgccactctctccagtcccccaactgtggatactcggccgccacctcggaagctattaggcagggtctcctttccttgttcaggatccccatgggatttgctgcttctatcttcagattcaaaagcagctcttttgcttctctcctcatcttagtgttacctaggagatcagagatttttatgagttaggattgacagtctgatcatatttatgtgagctaggcaagaaaagttaaatattggagtctctcattgaatacaatattatttggataaaaaattgtctcaaacattgaaagggtcattttctaaaagaatttattttaataaattttcctccataaatctatatgaaatgccctgaaattcaaagttatataatatatgagaaaacatcaaaggaagcaatgatattaaattcctttccatccttgaaaattctgctaagttattttaccccacccactgcatgaactcaaacatcgttacaagaactcaaacagcccagtgaggtgcaacacagcttcttcaagtacatggtaaaccactcctcgtctgggaaggctggagaggaggtattagtatctttgatcagcctttgactcaagtgggcctgaaatttgtcctagctcatgactgtaaatgtatacatttgcatgaggcctctgtgacatcatgaccaaggttattacatcagagtggatgttgctaccactacctcttgcattattttgtcttgtaataattgtattactttatggatctcttttaatctgttttcaactccagccaaccctgcaatgatacataagtacatggaaagacaaagatgacaatctttgtgccaatgacacaaactcataggttctgaggaggagcaagaagtaattgacttataatgggtgatatgatggcattctaacataagaatgaagtgaaactttttcctcctacttcctgtccactttccctccttacttggaacataaattatggtatttatcattttcatcttaactaactcaacaactaagccaaattttcactttcttccataaaaaaagtaaatgttaatactgaggtactttatgtaatggccggacttggtcaaaagttttatttttctgcccacttttctttcctcttcataaagcttcacaagtttctctagactcgaaaagcatttattaaacacctaccttgctgttaccatgaatttcaatttggcgacttcacatgggacatcaaaatctgacacttgcaggaaacatctaagagatcccacagattctaaaggaaagtagaacacaattttaccttcttggctgtaactggtttccaatatcattttgcctctgaacacatgttcttgcctctgagccttggggcatcacctgtcagagacattagaactgccacagatgcttgtttgggatgacttgaccttgaaatatttatagttgagagctttggaaggctgcagtgtctcttcctgtaatctcccactgttctgattgctctttctgtctgatttttggtttatccacgtaagttgacatgcaattagctcacctcccaggctttccatcctagcttgtcagcccatcccaacaacctttactttccctaggctgttatttaccaccaggccacaccgtgactccaggcagcataagttccatggaggacttaatgtggctaagggcaagtttggggaatctttaatgtgaatttggtttgcagtcgcttatgaagtagaatatattccagaggaaagtgaagaaaacaagcagagactggaggggatatgaacctcaaaagaaaactagactggcagagagccatagcagttagcttttctcctctgaaacctccccaaggtgtgtagcatatgggggatagagctcaggcagaaagcagcagtcttactcggttgaggcatcagagattggagcttgggtcccagagcagctgaaaattgggggaaatctcagaaagaaaggagtcaaagagggagagccctataatagacatataaatttccctcaggtccgtgactgactgctgaacctcacatgcttggggatgactccacgcggcccagggaaaacaacagctgaaaggctgaaagcggatatgtcagctgctgcctggcactggggagacaaactgagaagtgcaagcctctaaagttaaaggggcttgataaacagttcagatgctccactgaaagcctatagggaccacatctcaggactaagggcacacttaaaacaggcctaaaattaccacaaatgatgaccctccagtaattcaatcaaagctgaaaacctaaaaccacctctggctttgtggcttgtaattacaatcctctgataattcaacttcctattagaacaaaactcaacactgttcagaggaagatgacagaatccagaatctcctgagccaccatccatgaagtcaaatatataataaaaaaaattaatagaagaccgggtgcagtggcttatgcttgtaatctcagcactttgggaggccaaggtgggaggatagcttgaggccaggagtttgagaccagcttaggtgacatagcaagaccctgtctctaccaaaaaaaaaaaaaaaaaaaaaaatagctgggcatgttgatgcacacctgttgggaggctaaggtgggaggattgcttaagcccaggagttggaggctgcagtgagccatgatagtgttactgcgctccagccctggcaacagagtgagaccttgtctcagaaaaaaaaaaaaaaaaaatactagatacacatcaagtagattctaaattctcttgctttgatcttgcttgctccaaactctgacaggtcttctgccatctacaaggcagcacagtgcccttcctaagatacctctcatgtcatcagtttctgttcttaatctgtaacccaaaatcctagctggacaccaaagcacattgttgaagcaaaaggcacttagtatgtttcattcagagctatagtgtgccatcaccagagccctgtgacagttcaaggaaatggagaaaagtgaacaaatgaattacatttttggtttgaattaattatgctcttttcttaatttctgttcatattcagaggcaaatgttgtccaagagatggagacttgatatttggaatctaaactttggatgcacaaacttagtgatctaacaaaaaataatcaagttctaatctacccttaaaagagtttcaggagtaatttgcagattctttagtgctttgacctaaaattataggtaaatggtcaaaaaatattgaatgtatggtaacataaaaggaaaaatgatttcctgcagtcaacatctgcattttccccttaaggagggggccagaggtggccaggaccaaaactgagaagtaagcacagctcttattttttccaactgagctaatcaatattttttgtctgcttatttatgtcttcctacaacagctacgcatattcttagatatttatttcattatcataaactagaaatcaagctaaagattaaagacgtctcaataaattccctgaagataccaaataccttcaagcagatggattagtaataactctcccccttttaaatggattatattctaaaataggtgcagatcaaacaaaatgatatcaggaatcactattaccaggaccaaggagtgccagttattctttcattttaggacttggttagcaaagcttcagtatagggaaataaggagcgcacatgtccctgttcctattcccctaaccatggtagacattgctaatagatggagatgctctaccacactgagccccatccaagactcagcctatcagtcaatcattagcagtcaagcaatgaacatgaatgagactaattttctatccttaaaattggcagtcgtggaataacaacatcaggaggaaagaaaaagggcagtttttaagaggggaagcagagggaaacttttgtgcttttcatgaaattctgttattatcctcccatctatagaccaatagaaccataaaggttacttccacctctggaatttaatgagttaacattaaaaaatgtcattgattttgaaacctccagccatttagcatgcacacttcaccttctataaaataaatatttaaagtttaaaaactttccatgtagattcctgtagggaattactacattccaaaagcactatttcaagtgcattttttttctagaaaagtttttcatgcaatctcatcctttctgagggcattgaacaggaatgggcattccttgtaatcaccatgggttcccttgaggaactatttagtgggttcctgtgtacatcagcctattggtctggatcaatagcagacataagaacatgagagatgcagcacttgggtcagaccctaggtcatccattcaaacattctgtctctgatgttggcaccaagggacactttgagaaacaaaggagtccaagaagagtatcaagttctgcacaccacagggaatttaccataaatatgtcactttctttaatgagaattcattagtgacacagccttgataatcacatgtgagcaacaaatgcatgccgtaggctcttgcccttgcaaacagacctcctatctgctgccatgtttgtggcctgggaaaactacattattcatgagattgctgtattttctacagtagctgctggctcaaagacatgagcagcactgatgccatggtttttattattgataaagaaatatgtttctagtttgtcaaattacatttcagtgctctgctaggccaatagtctatgtaactaatgattggggttctttagttccaaagaatgtctgttctcttccaggagaaaagtttgtgggctgattgtttaaaatcttctgccaatacagacatgagaaaaagagctcttaagtgggaaccaaggggcttctcatgatgttggatcaacttcagcatcatgaacaaggagcaaaggcagtttctcaatctgcattcaggagtgaggtagttccataatgctatctagattgcaaatccaccgcaaattgtccatacagactattgccatgatttaggggaaaattcatccaaatgtgtttaagttcttttctggaaaaacaaatctttgttgaaatagagagagggaaaagtgcaaaattcctaactctccttttctaaatatgggttttccagaagtagtcccagaaacaaactcaagtacaagttgtttgtttctgagatgatcccaaatatgggagctgggaagtgagacaacgagacaatgacagataggcaaccaatcataggcatgttaccaccgtgagcaaccagagcttagttgtgctgggaacccttaacagtgtagaacacacctcagcgttatctcatccaggtaatgagggagctggggtacttatacacccacctttcatcagactttggttgacagtttctcttgagagaaagagtggtattaattctccagcatatccagcctgcagtgcctgggcaggggaacctttctcagctctggagaaagccttcagggaaagagatgaaggtgcttagtacaaaagacatagggccccaggactgtgggcctggtattgatgtcttgggaaactcccctatccatatttctccctctccattatttaataaattagagacaaacagagctatcatttgataggtccttgcccaattttaggtattgcatatttcataagcatcatcatcaatcctcataataaccacataaatgggtattgttttcattctcccattttgcacattaacaattaagactcaaagatgttaaagaattttcccaaagccacagaacttatgagtggtaaaggacggattcaaatccaggccctcaggctcttgtaaaatgctggttgcctgtggtaagcaaatgtcaccacataagcatttggctgatccaagttttcttagcaaatttgattggcaataccattttgattgatagtttaatgatccctctaggccatctgttcccatgacttgtggttgcatcttccttcacagagatgcttctcatgaccttgttttcattcacacatcaatccatttgaatctgaactttgtttctggtttttgaagggaaggacttatgcccttaaaaaaacaagaaaaaagggggtaatttgttctttctaggacagtggaatcaacatattagaaagttggaccctagtttgatctcagctcttccactaacgtctatgtgaacttggactggttacttgccctctttgggcctcagcttacccatctgtaaattgggataatgcttcctatcatatagaagcaatgaaaaagtgataaatatattttcaatacttgataaaggttatttccattcttaaattcagaatacttaaggtattgggatgatttcaaagagagtccccttgctcccaagctaacctcaactgttaactcctcagtgataagggctgtgtacctttaactagtattgagtatggtatccagcagatggtaagtgctgaaagtaagcagtggtgttttgacacagtattgatttaataaattttccaatgttattaagatatgatctttagaacgagacaaaaattcaaaagatgatctaagaacagactggttccctggaacacccagcacctcctgttgccagatgccttctcccatgcctgcctgaggtttacttgacctcgttgaatgtaagcatgcattgaaatgtctctaaaacatttccaaagactaaatatttagaaaattaagttatgcatttatgtactttcacacagattcttttgtggataattttgttcaggggcctttatttatgacaaatgtgttaattgcctcaaccaacactattaagtgatttgtgtgccaggtattttgctagacaccagggctacagagaagaatcaatatcctacaaccttaacctccctcccccagtctactggagaagagagaaaacaaccaaaaattgctgcaaggcaaacaacgtgcaaaaggctgtagggatgccaaggagcaaggaccatatgcatttctcacaaggagctaggatatgctgggtagcaaacagcccccgaagatcagtggctacaaaatacaataatgttatttttactcatgctacacgtacaaaatgcatgtattggggttggggattctggtatcagtcactcagggatccaggctgatgggagatgcacattgcatcctgatgtacctttcaagaaatgctgagacaagaaaatgcaaaatggtgagccaggcactggtttgaaagccacatgcaatccacatcattttgctcacatttcactaatcaaagcaagctgcatggccttacctaactttgaaagggatgtagaaatactcctcctaggtctctggaacaatgagaaatggggtatttgtgaacagccctcattgccaccagagttgggatctagtagttgggagtttgactgagctgtccctcccaacaccatttctcagccaataattctgtcttgtgtttatacaaaaccacttcctgagagaaaggccctctgcattcagtcacacttgatatttgttgtcctctttcatgtatcccagcctggtgggtgctgatgacaaagagagaaatgacagggctcctgtcctcagggagctgagctcatggtgccactgagtccacggtacacatggacaagaaaatgcctacagtgtggttggaaaataatttgatgagcactgggacaatgcaactgggccacagaaagagaggcagggaaggctttgtgagaagcggaggaggtaccgcacccggaagacaaagtttttacagtgccccaggaaaagtgggagcaacaggctttactaagacagatgaaagcacgtgaaacagaagcttgaagccactcatcactgcagggggaagctgggtagcatccagactgccatccttcggtgcaattcctgagagaccaatccctcaagttgcatgggtattttgtcatgagaaggtcactgggatggcagactggtattctgatggctgcagcagcccatgttccttttgctcagacatgttaagggagccaggctttttaggatgtgttgatcttcattttggcctgctccatttgatcaatatgtgatgagtatgtctaaagatggcatgaatgttcctgctgcattttttttcaagcaaaggagaaaagactctacctctgtgaacctccgtttagactcatcaaactcgggtctcatgaaagcagccaggagggagaagcaaggaagctgattgctgttgccttggtaaggggaatccactccactcaggtccctgtggtttccatgggaacagcaccgcttgcttctgcaggcccccagggctggcgggatgcactgaaaggaaaattgggggatgaaagagaggagcagaaagagactttgaggaccttgaaggtatttggggaatgactctcagctggatgaggctgctccgttctccctgcataggtagctgctgttaacaggccatgtgggccatgtggccccaacaggctgagtaccagaagcacctgcctagaggcacatgcatttatgcagctctcatggactaatcaccatccaggtaaacagatgccaatgcaagacaggaaggaactggcaatatgtggatttcaacatcaagaccagagatgaatgtgtcctctgcccacaccaggccagcatgtcattgttgttataatttagaataatgatatgtgaccccaggaagcatggcggtaggtatttcacattcactatctacactcttcataacaaccctgcagggatgacatcaacacacccatctacagatgaaggaaatgaggcccggtgtggcacagaaggagatctggacccgagcctgattctccactgtgggatcttattcaaaatctaactgatcacccaaggaaaatgttagttcccaaatacagcaagcatcctagctcaagccttaaaaaatgcgctgagtacttttggatttggcgctaggatgcacacctggagagggtgacatcagcaccagccatcagctctgggaggcgctagaggccccacattgtcttacctcttgttctagaagtgaaccaactgaggccaagaagcacttggcagagccttccagtccagtgcaccacactgtccgcatacactcttttcttggacagctgcagctattcagaaaatcgcatgccccacacacacctgcaaggcaccagagtgtgtcgccagttgaagagctgttgcagtctccaggaggaaagcacagctgctgttgcagctcttttcttgaaccactgggtcaactgggcagagtggatttaccccatccatgcctaaggtctgttctcagagttcttcatcccactgagacttatcaggcatctgctgtgtgcactgcagtgtactgtgtttggaccagaggcaatgggaaggaggatcctcagaggccacttttcaaatggccaaaaggcaaattgagtcccagagagatgaaatgacaggtggccaaagccacactttggaaatgttggcattgagccccacatttccagattcccaattgaggacacttttcttgactccaggctgaccccttccttaggaagattaaacactgtgataccaaattgctttagaaccacagcaaggcaacgagtgaaataacaatgttattagtaggctgtgtatatagcacgcacgtaggagctgacaaagatcaatgacaatccttatggcctccctaaacgaagctgctgccccagtgggtctctaagataggattcttcctgatttacattctgtgctgcagggtcatctggcaacaaatgccctttgcaaatgaatcaaagaagcttctaacatggtggaacaggatatgtaatataagaacatgttacaaccctaagtcttaacattggggtcctaccatgctagattcagaatgcaagtcttaataacagtttatcctgatgttatgcttgtgcagagggactcccttctgccacctccaccccatgccccactgctgtgtgctgaagctaattatgtgtgtataagttatggtctctcctttcctgcaataagataccttgcgtctcctcttcagttcttatgcaaaggaggcttcggagatgctgtgaactgaatgtttgttcccacttcccagattcatatgttgaagccctaacccccaaaatgatggtatttggagatgggacctttgggaggtaattagggtcacataaaggtgtaagagtgggaccccaatcatgagattaatgtccaaataagaggaggaagagaccagagtttactcatactctgatatgtagatactgtaagaaggtggcctcagccagccagaagacagccctcatcagaacccaaccatgctggcacctttatctcagacttccagcctccagagctatgagagataaatgtctgttggttaagctcccaagtctacggtattctgttgtatcaggctagggcagacatggggcattcctacacccagacatgcggatggtttcttgatatatcacctgtgactctttctagggccttctctggccccagaagcatgcttggcttggccagtgcagggctgagcagaagtgttgaagggtcagtgcctttgggacagccctaaacagtgacaggcaggcgtcagtggacggagccccccaccctgctgctgaccctgcagtagacaactctgagacctgctttcctctgtctcccagcaagcttgagacactgtgccagccccttcccctccctgcctcatctctccaccctgctcccgatgcttcctgggatcacctcccaaacaaacagctgtcattcaaatctttctctcagggtctgctcttgagggccccagcctaaggcatgggcatttggaacctatgagggaagactcacctctcacagggtaggagaagagggcttagctcaatttttttttttttttttgagatggagtctcgctctgtcacccaggctggagtacagtggcgtgatctccgctcactgcaagctccgcctctcaggttcacgccattctcctgcctcagcctcccaggtagctgggactacaggcgcccgccaccacgcccggctaattttttgtatttttagtagagacagggtttcaccgtgttagccaggatggtctcaatctcctgaccttgtgatccgcccacatcggcctcccaaagtgctgggattacaggcgtgagccaccgcgcccggcctgggcttagctcaatttttagatgaaatctctccctgtgacttttttttcaaatgataatgcatatctaaaagggaaaataaaatatatgtagtattctttgcaagctgtgcatgagtcctttgaaaccatttttccaattttgttattttcctgatacgtgttttctgagaggagctgtaatgaaaaagtggtcagagtgggtggatatcaggtgaagtttgctaggtgagtatttaacctggtcattctttccacattgctattggccatcaaataagactctttgtttttcttgaagaacagtggttcaaaaccgttagactgtcctctgccttgcccaccctgaccctggagctcccacattctacccacattcaactcggtgaggaggcccacagtgctggccgctccattcacaagctgtgctgctgactgtgccagattggaggctctcattgccccatggagaattttcacacacttcctcatggccagctgtgactgctgacaagaggagacagttttgatagaggagctcccagctgggcatggatcagagagcaggccctggagagcagaccaagatcaggtcactggtaagctgcccactccctgaagggaggaaagggagggttgctgagcctccaaggaaggaggaccctgacgaagctcctgtggtttctctttggctcacccctgcccggccaggactttgggcagcttctgggtggactgtcccgagccagcatggggccctttgggtcctgctccatccagggctcagcctccagtgtgtcttccccaggggtcccagctggggccaccatgtgggctggcatggagacccctgacaagaaacctcctccaccagagaaccaggcccagtgggatacacatatctgcagttgcttcattcagccagttgctgttcatgttgtggagaattgaaactcagaatgcctggattcagaacccaagcctgtcacttactgacatggtgtccttggtggaacagatgtgctccctggccctcagtggcctcatgcacggggcagcagtgaggcaagagaatagagctgggctggggagaacccagtgcagacgtggatgatgctcatggggtgactttcactcctttcctgtgctccctcggtcccttgttattgatcacggaggaagcttgtggggcggaaagtaaagagctaactggatgccacatacctgtacccactgtacccctcgttgatgattggggacctcaaataagaggtttccacacgattcctttgcttggcactgccccagggcatatgactggcttgtttcccatgggtgatggctgttgtgattgatacattaactcagcatcccatctctagcttccagctctgagactaggagaacaataggagaggtgacctttcaaccctaggactggccagtgccaaaacaccctgtggcagctacactgaaaaatgcaaagaaaaaaaaaagcctattgcttctcctccaggagagtggcagctgaatgtaaatcaggtcaaatcctcttttggaggaggtcacagaaggaagaagtcagagggcagaatggaattgcagatccatgcagtaggggggtggcatgtgtgaggggcgtccccagccctgggtttgctgggtgtgcagcccttctcccactttccagccatggagcccaagcatgttgccccatctgtcttccccttgggttcctcatctacagaactggaataataatctgtttgtgaggataagatgggatcacaggggcaaagtgcaaggtacagtgcttgccaggagcaggtgctcaataaatgctcactgttgtcatccctctgcccctcacattaatttccagatcgtggcttcattttggtccccaagggaaactcctccaggcttctcccagtttattcattgttcagaggggctctgtgcagcctgtttagagcagcttcagcttagaaaaatcctcccataatcatgatgttcctgtcttttcttgtctccttttttatgtttaaaggaccatacaaaactagagattgtgattggctagacacacaggtgggtcttgctttttttttagaaaaaaaaaaaaagcctttttgagatattattgacgtataaaaattgtatatgcttaaggtatacaacttgatcttttgatatacagatacattgtgaaatgttaaccacatttcagttcattaacgtatccattacctctacatagttatcatttatgtgtgtgtgtttgtgtgtgtgtgtagtgagaagatttagatccatcctcttcgcaagtttcaagtatataatgtagtatttttaactgtcccccacttgctgtactttggaaggtgagccttgctttatgtactagacgtaccctttggcccaaacacttcgtgtggctccaacccaatacctgcacaatgccttaagccaatgctgccttggatgcagagagcagagccttttcaagcagtgaccgatggcttgtgtcttgcacaaatcctccgggcaagccaggggtccccagcagaactgggcctggatgtctcagaggtcatccactcactccttagcagcactgtctttgtctcttctccccttcctggctgcactgcctccctcatgcacagtgcatcctggagtcatctcccaagtaaaccacatagctccacatccttgtcggagggtctgcttttagaggaatccaaaataagacaggtggcaagcaggtatcatctagcatatcctccccatcaaatggtggtggtttctctaagaacttgctagagaaagacttggagacatcatcaagctcagagggaaagacttctttcagcagctggtgatgtctgcccatgtggggctgtgggtgggggtggtgtgtgctgcttcctgccgcgcctggtgggcacatcctccagcaaaggagccgtggattcctatcggagggaccacaggaggcttcataaaggagaggagatgtgagaacctggcccagaaggttgattggattttatgagaggaagggacaggaggcctggttagtggtggaggaccttcttgggaccgtcagttcacagactccagctttcatctcaaggcagaaaggttttggaacattgagaaggcatgaacatccctgtggttggcattctggtccagccacaaatggaggtcaacttagaaaggggagcagagggagggagcagggagggggttgttctaatagcacacgaggcccacaccctaagccaggtcaggcaaagtggaaaaggagcaaaatgaagacccacttagagcaggggcttcaaatctgtctgagccacagacccttttggtgatccagtgaagcctacagcccccgctcagaaaagcagttttcaatgcatgcatgcagcaaagtacataaggttacacatggaaactgactgtgtggaaatgaagctgtcaaagtattagaaaacaaatttgcaatatagtagttcacgtgcttcctcattaacactttaagtcacaggtggtgacctaacaaccaccataagattgaagcagtgggtgagagctgcacaagtatgatggtatgacgtgttatgaaaatatctgtggggccgagccccaggttctgctaacgctactgtggttggttgcccacgttcttatctgaaggaaacactaaattctggttagttttgtgaacttaaagattcaggatctttttttcatccaagttcatggaccccatgttaaaaccaagactcccagacctacagcactgaaaatgtggtcacctgtgctgagacggttttctttctctgttctttagccctgcatgaattccccaatgacatcttcacaaacgaggatagaagacaaggtgcggtggtcctccatgtgctctgtgtaagtacccctctgtgcctctgcctggagggtccataggctaggcctaggggtgtggggtgtggcacctgaggtgcccccagtagattctctctgccctcctgttcccacgctgcctggtgggggtccttcgagctctgtagggggccatcaccaaatggagatgaaagaccacagctttcgaaggtggagccatctgttatgcactttcccttcatgttagtgcccagagtgtggactctaaagtcaaacagccccactctccatgacttaaccctactctctgctcaaacaccaccctcttggggagccctttcctaactggcctttctgaaatgccgccatatttcctcttaccctgctttgttttcctccatgctatctgccattgcatagttatttgcttttcaacttttcaccctcactcacacgtaagccccatgagaacagggacttggttttgtacacggcttcattcccagaccctttcttggcatgtggtagggacagaacatttgctcactgagtggattatatgtaatggcaactagcaccatgtctgacacatagaagatgaacaagaaaagcttgttctgttcccatctggcctcttactttccaccactgcccagcatcttctgccacagagccagtggctctaaagtctgtggtcctcttgtccccatttggagggtttgggggagggcatacatgtgacgatgtctaaggagtggacagctgtccaacaagaaatctctgagccaaattctcgactaggtacattactgcttccccatctctgtggcattccctcccccttaattccattctagttatttatcgctgtgaagcgagctccccacattcagtggcatgcctggtcaccatgttgttttgttcttgggttgtttgtgttgagtgctcagaaggagcacagtgggaatgctgctccacggaatccagggcctcagatggaccgactccgatggctgtggctagaccagtggtcctaaagggtttctctctcccatgcctggtatgtggggtgggatggctgaagggctggctcagctatggctactgagaagagcacctacagtgacctctacagcatggcagcctcaggcagtcagacttccacgtggcagcccagagagctcagaaagggagggtgacttagccttgaagtcccacggtgtcatttccaccattacagtcacagcccactgtgattcaacggaggggtcagagaccttgctttcaacccacagctggagcaggtcagcaggcacagcctgggctgtggagtcagagaagacatgggcttgaagcccacttctgctggccttgctttatgtgtcacttctgggaggacacttgacctcttacgacccacaggccaccttgatcttgactctgggtaaaatcaatcaactcttcaactggtctcccactcccaaaaaagggagcatgaaaagtctcttttctacaaggacattctctaaaaataccaaatgagtaaggagagcctttgcaaccccccagccctccctgcctttcagggaagttgtgtgcactgagccattaatatggatggcaccttcggcaccaaggaggctaccctgtcgcaaggctgaggagctccaggcactgagttggatccggaattccctggcagccgttagcatcctgatgctttgacatctgagatatgagatttccactctggacccaaacactgcgtgctttcatcctcctgaagagatgttgtcgcctgcagctgcatggtcctttctccccacctccatctcccctctggactcactgagtcatcagctggaggtggagggggttcatttttcttgctcttcatgagcccaggatacccaggaaggtttctggtgtctgtggtagtgcatttccaggctggcataaaggcaacatggacacaaatgcatactatcctccttaaacacttccctaagaatgggcatgagtctacatgttagcacttcgtaatcactggaatccgatgccactgttagcccctgccctgggccctacactttagaatccatagggcaaggagttcatggaccaaggccagtgcccaccccttcaagattatgttccaagcacacagaagcccagaattctccacccaaatagccatgagcctgctgccaaggcccttgcaggttttctccctggctcctcttcttgtagggaagagacccaagtggggcaagcttcaacacacaacatacatgcctgtgtccaacgtgaggccaggtgggcagagcagcagggcagagacaaatgttcgggtggacctgctggtgccatccccaaggcccaagatcaaatcttgttatcctacccactagaatataagcccctaccaccagaatgtaagccccaataaagaagccccttcgtactgtgtccagccattgaatgcctggagttggacagtcactttttgttcagggcaggagtaaattattctttctatccccttcaccttccatgttgtacagcacatttaggatgctcagaaatttttaaacaaacatcattggatgtaagaactgctggaagggtaacatctggcatttgactggccagcaggaaacagatgaatgcatgggtcaaagctgcaagaagcaaaatacagacttcctgcacttggacatctagaaagcactttttgagcccctgcagagtagtgctgggctgagtccttctagatgctcaggacatggcttcactctgaaggaacctgctgtcttgtgaagagaaccacttatggtcagcacctgccatgcaccaaatgctgacgagggtctatacagcgtgctgtgctgtgggagcttagaggaggcaactcagtgtcaggaaggccaggtggtgctgttcttgaagagtgcaggcagattccaaagaagcatggagaaaagggactccacacaggaatgggaagcctcatgatcagagacacagagaggtgagagtcagggagtctagagagagcagaaaccaaaggtgttggtgttggagagtgagagaatatgagcgtggagagactgacaggacctcacatgggaggcaccacaggtgatttagctgctgcgttggagtggtgagagattcctgacctcaccgtccctccttgcctagggtttgtgctgcattagctcaggcttcgcccgaagtgacccagagtcatctgccctacagtcagttgagaagagcccaggcaggacatagaaaaaggctcagggccatttgggcaggtgatcccagagtcccaagggccctagggaatatccagaagggaatgtggaggacagaacgaccccaggaggctgtctctaggctcctgaagatctgggactgccttatccaggcaggggagtgatggtcttctgctggagggtcccagaggggtgtcctgccacctcaggcttcccccaagagagggccatggggctgtcttttcctggggttcactgctcgtagtcatggatctggaccagagggcctagtccttgctgctccagtttgatctgaaacctgatcacacttagcattggcacctacactcaacctgcccctttccatttgggccccacgagtttgctttgcttctaaggcttgcagccttcagcctcagtctgggtagaagtctggagacacagatggttctgaccccttgatacactcttttaaaccttaaatgacaaagcttgcattctttttgttttttcttgtagatacttccctgttttgtgtgtgctttgtgtgtgttttgtgtgtggctttgaacagccattgctggttcaactttctgaacatcgcagcttgaatgttcccttggatctttcgtgttttatgtatttcagaaatcccaagcctgagagtgtgctttttaaaaaaggtttctgttccttctggctgtttgtcatgtatggtttccttactagtggggaaatccatgatcttgacaactttttcaacaaaagatagccccaagaaaacacttgtcttagaacttgctttatatctaatctattataacattgaaacactaaaagcaggatttcctgtctgtgaggaaatttgcaccctatagattcattgagcctgtgccaagtaaaggaagaaggctatgaatgattttctagaattgtagtttgtttgtgatttatcaagatcttgtgaaattttgctcattatccccatgacacaaatagctgaatctgggagattataagccaagctacgcatttctcttccagtaagagtctttaaatcatcaatatttggaattctttctcgaagttggtgtgggtggctgcctatctttaagagatcaaactccacagcaggaataaatactctctgcacaccttttcagctttcaaaagtattcttcctaagctttgagccttgctttccgatttttaatgtaattcctgtcttctggaaggcagatatttctatatgcttgtgtgtatgagagtagaaggtgtcacacatttgaaaatgattctctatcccataccaaggcaagctcttgttaagtgagtctgtttggtaggagggctgctaattagtccagcaacccagacctgtcaatagatgtgctgggaaaagacatatcaaggagaatattttcaatgtgcgtcttcattttctaaaccctaggcacgccctgagatgtcccataggaaacttgggaattcaggcagaggggacttttccctccactgagctgttggagttgctgccatctgcacctcctcaggttgatcagagcagcaaaagggatgttctggccacgtgggaggtccctggccatctgccttaggccccttctgtttagtggtagggactcccttgtgcacatctccatcttcacactcctgtgtccagtgcccattaggggctcatgttattaaaggaaataggctctctacggcgcaggtcattccggaagtccaagcaggattcttgtgctgagctgagccgtcaagccggggctccctacaagtggaggttctccaacaatgaggaagaggaccattaacatcactccttttggtgtctgcatggtgagggtgcccagggcatgatctcaaggttggtggtctcccctgttccccgcgtcaacacctgtccgcacttctttcttcctcccctggacccagggaattttatctggtctgggaattggggaatctcacttatgagcttacatccaaattctctcttattcctagatcagcttttaaacttcagaatgtgctttctgtctcatgatcccattgtgacctctttgctccccaaaactgcagaggaagctgattagcattggagggcagcctttgatatagaagtgatgaaagtgattggagtactggggaaggagggaggctagtcacatcttatcctccctctggctttgtggttttcaggtccactgtctatttctggattttgtgttattcctagcctagcagagtacctaggtgacctgaaccatgctttccttccctccttccctctttgcctccctccctccccacacaatccttattctctcagaagaagtgtgtctctgcctccactctggccctggctctagctgttgtcatcttttgtgcacttgccctgcttcttcagtacctcccggcactggtcagtttcctaatttatagtccccagaagtctctaattattgggccagctcatacttttcctgcctggccatggggtgaccatcccctataggttgactccccctgggtcaggtcttaaccagtcagtgtgaccaaatcacacaggtttccataggaggcctggagggagaggagtctcagctccacaaccccaccttcccatcctcagcaaaagtggagacttatgtggatgtgttcttgaaggagcatgaggctgggacacctcctgggagagcccaggttccaagtggaaaggggtcccttcctcccagctgactgctcctctttcaggtctgggggaggagaggaggaggaagctcttctttctggaaggagcctcaccaaatggatgtcatttcctggggcctgaggttcttccagttatttctgctatttaattttaatatctgaaagaattatttccctgggtgcactcccccaggcccagattgctgttgttcagagccaaagaataaactaatgatgcagtagccagttcttagggggcagaagaccagggtcctggcaggaggtgcagaaggccccttccccagcccccatctcctccagtattttgtatatttaagctcactttccacctcactcccaggggtatttttttttcatggtctttcaaggatgtcttttcacttttttggccctaagactcaactctccatttgtaggccatcagtgtctagcagaccttccccagctgtccagtagtctaaatctgtgctgtctaacgtggtagccactggccatgggagctattgagcacttgaaatgtggctagtgtgaatgaggagctaacttttttttaaattaacataaatgtagatagccacatgtagctaggaatcaccctagaaggcctagcaatgaattctaattcagtatcttcccttcctcgtttatgtcatcaacttgaaatcaagaagcagaagtggctggagaaaaggttgtcagcaaagagacactgctgctttactcagtcctctcaagggctggcctggctttagccatccaaacaagcaggatgtatagaaggcactgccaggccaccaggcttaccaaaacaagggaaggatgagatgttctggtaaggaggaaggacacccaagttaaaagctagaaaaacatgtatatgaccaacaagcttcctgctttggaacaagtcccagaacttctcctgacctcaatatccacatcaataaagtgggaacgcatggtaggtgctccgtcagtgttaaggtttttgatcttcaccgtctcttcccccgcaaacgccaccaaaggcagctcagctgtgcttgccaaccccatcacaaagtacctcctgtcacagggccagagcccaatccattcagacggagctgccctccttgtgagcaacagaacggggtggcgcaggaggcctctctgcaactggtgttgctgccatgcccagggctccaggagaggctgctcctgcagggttttttttttttttaactgaataacaataatcatctatatttatggggtataatgtgatgttgtaattacattgtagaataagcaaatcaggctaattaatatatttatcacctcacattcttacttatttgtgatgaaaacatttaaaatctcttttaccaattttgaaatacatattattattaactataaaaaaggaaagggagaagtgaaattgtctactaatgacgtggtcttgtatgtggaaaacccaaaaaatcctgccaaaagaccgttaaaactgacgaacaaattcagtataaagttgcaaggtacaaaatcaacacacaaaaatcagtagcatttctatacactaaaaacaaactatcttcaaaagaaattaagaaaacaaactcatttactgtggcattaaaaataagataggagtgcatttaaaccaggggggtttgaaatttgaggggacctgcatgatctggtcagaaaggtcccagcaacaactcacttgcagggcagacgtgtttagttaagggattttactctggaagagaaaaatgattagaatagcttgtggaatttgctgtttactcttggaaaagtgctgagcatgtccttaatttgtcagtgtcaacacaaagctaaaactggtgtccagagaggattagcacaaagagagtaaattatgtttccatacatcagtgatttaaatcactgcctcacccccttgatcatgagacttaattcagaaggtccaggtctaatcattcagccccacaggccccatggcttgctggtgggttgatatcctaggacctgagctggatataaagcatgacggcttagagcatgcccttgcagtgaaacccatctgagtcgtagtcctgaattttccactttagcttgtagccatgggaaagctgttttgccttcttgagcctcagtttcctcatctgtcacagcacccacctcatcaggctgccttgaagaacacatgaaagcaggtggatgaagctcttggcagagtgtctggcactgaatagacgataccttacttgtccctctgcttagttcttgctacctgtgcatgcccacccaactttaaagttccagcccctgcaactctgggcattttctggaccctcacatcctattctacctgaatactggacaggcaagaagtgccaggaaatcagcatcccccagaagaaggccttagacagacaggggattggtggtggataaatgcctgttccctctcgcttcagctgggctaacagaaacacatgttctagcctgcccccgaaagtacccccaaaggaataagccctcgctgtctgccccagtgccccacttggtaacacacctttattagatgctcttcctgccctgactcacttccctgctcctctcctggaacctcctgggatcccaattaaatgacacgcactgaaaaccacctgcttctgaggcacagcctccatagatgtcacctaccattattattatgcaaaacccacaaagacttcaggacgtacagaatcctgagactccagtccctcctcgacatccacagcaaaactctggccggagttgacctgcaaccagtttggttaatgtcttgaggctgggcaagatagaaggatgtttggggaatgagctttgaagtagacagtttccaatttgattttatcatggcgccaaatggtggtagaggagacataattttgtgttttagctcatccctgcccttcagtagagagcttatgcacattgcttagataccaaacgtttacatgtggagattagatacatgcagcctgctgtatgctcctcttcatcttacttgtttattactcagtccacctgttccccacttcatgtatttcctttttatttattttatttttatagtaaataagctttatttatttgttcttctgggctgacattgcagcagtcacagatctgcataacatagttacatgttgactatatctacaatttacaagagtatttttttcctctgaaaagcataagaacaaaagctaagtaaataatgaggtactactatttggaatgatcatatgtcatggcttaaagaactagtcttagcaaatattcagcaaatcaatctggataaaatagccaaccaaatgctctaatttatcagggcacactccatgttggcgctcaatggttttgtctctttgccaatagttttctgacaattttgtacctgggaaaactgcagaacaagacctgctgcttatcatgacttgagacttcagaataaacactatccagcaggagttttgtttttatgccatccttcccctttctctcccaagccagccccccttatatagtagagactccagataggagtttcaagcttaagaagaatctgatcttacagcagagaagcttccctatcccaggaacctggatatgcagagtgttctgcagccagtgtcttgaggagtcacttcctcctgaggacccacaccagaagagctacaggagccaagacagctgtctcaggctgactcccccagaagcagaccctcagacaaggaggccagggcagagactttggatgatggtcccaggaagtccactatggggagtgaggtagagaaggaaggcagccctgagggtctgtgggagagccagtgacggctggggagaaggaggctggagcttcatcccactggggaactggcaggtcatggagaacatccacaactgatgacctcaagcagggcaggggaggaggggcatctatccaccagctcctatctattgtctgtcgagggctgcttgggggtcccaaactcatagcatttccagtcggccccaccaaagccctcacacaaatggacgtcatggggtttgcatactcaggagagtggccgaggacgaggacgggcaccaacggtgcctgtgacaacacacaccagatcccacccagctgggccgctcaaagaggggtagacttgcacctgtgcccacccctaggcttcagctgaagctcccagcctgcagactccccgtgagtcttcttcccagcccctcattccacaggcgcggctgtgcggtgaggattcacatgcctcacgagggtcctctgggagtctcctgaggtaggtggctctggcagattctcctggagtttctccagttctgaacgaactcggaggtaggggagtgggagaggatgccctgcctctcatccagctacccagctttgacactccacctggaatggtcacaccctccgcgggtgtgctgtgtcaccccactgccagtctccccgatagctcttctttctattcagctcacatgtttcccttcctacccactgagccatgaagagcaagcgttttgactggtcccaaagcacccttgttctcttcagtgcatttcctccagtgctggctctgattttggacttgacaagtcctattggccctcccaccacttcccaggattagtgtggaggtcacgagtgcaagccctggctatgccacgtactgcctatgtgacccctaatattctgggcctcagtgtctccattgaggtagcacctacctcatgaagatgaagaagataaagtgtgtaacatgtttaatccagtgccccactcacaataggcacaaggaaatgttagctctcatattattttcatctcttctatgttggatcaggctatggtcacttcttgtccagaaagtggccatctaattgaccttcctggattcagtctattctcttccgatcaaaatttagctctaccaacaccagatcagcccttgagagcaacgtccaggtcacgctttgctcggaactatccttcctccatctcccccactatcagagggtccacatggcatggtggggagagtgggttttcagagttagacttcctgggttcaaaccccagccttgctgttttttaggtacatactacctaaagtaagagtataagttattttccttctgtctatcttgatttttctaaaaaatgtggataatgatagtatctacttcatagggctgtctgcgtgagaattgatcaatccatgccagatgctttgagcacagcagggcatttagtaaggacttagtaattgttggccattgtcgttatttttatttcagtatccccataatccatgtgatgactatgtttgcagtcttgcttttctcttctcataaaccccatgtatcacggcctagcaaaaattaattattcaccacccaccaagaaatcccagttcctgcctaggccccaaaacctttggtctccctgaaatccaactacaaactccagctagaagtcatttgcctcctggaagctttctttgacttcctataaggaagagtgggactttacactagcacagatctccctctactctaaattcccacttttctttgttgctgtcctgtaacatgtccttcccctcttcccagaatgatgttggagacctgggaccatgcctcactcatctttatgtccccatcatgcccagcacggcaccttgcatggaagaagtgctcattgaatgtgtagtgtgacggtgaatgaatgaagtgtgcttaagatcttggtgtctgagtatagggtctatccactaagctggtaagtgagtgatttagctgtggtttcataaggctctgggggtttcatcagtcctaagcataacaagatgaactttggggggccagaccttccttaagagacatggactaagttaaatactcaggaaacccctgctcatgaggcaggagagagcaagatgaagtaagaacacacaagtctcttatgccagtggcatgccctgtctctctaagaggtccagatagcttgggcattgcaaagatccagggacagcagagaccctgccctgcaaagacatgtgcatttcacagtttaagagtgactcagagccctttctgaacatttgcacaaagacatagcatctaaacaaacgtcatcattactgaggatcacgatgttctccaacttttattaaattaaattatttccctgaaggattggcttctatctactgagattttatttcagcagccaaattcagtgtcccacacatgaaaggtacccaaacatatcaccaactaagggcgggtggagtgaggtttgtaaatgtggctttggttttctaaccccattcagcctgagaggcaactactagaaagtaagcagtcctgtttgtcccaggctccaagattccacctagtaagggcccaggagtccaagctctttaagacccctttgtttccctgatattctaaatccttttttgtcctctttaaaggctcctgaaaattttcccaagctcttcccatttctggtgcttctttgttttcacagtttaaagaaactcaagggccccaaagataacttgtcctttcagtttgaacaacttatttaggaatttggaaccggatcccaaagtgctggttcaggggacatttgtaataaactgtcagccatcagcgctcccactcaccataagctagggacacaggttggtgcccattttcccatctctttaccttcccatctctttacctttggtgcccttaacccatccttatttcctaagatgcttcaccatttctcccaataatcccagaagctatttgcaaatagattttttgatgacatgtccttttacttggaaatcgccaagcacataggaaaatcaggtctacacgtggccctcactattgcgactttggtttggatgctttttactgattatcatgatgaatcctgagaatactgaaagataccctgctgcttgcccatgagtggattccaaaggtggtcatgaaacctaccttctcagctgtgtcattagcactctgattgctgctgttttgtgcaccaaggtagaagcctgaggatttattttttccccttattgaacttgttccagctgtcttttcctctgtactgtggaccacaggaattaggcagagggggtatttttggcagttagcttaatgctttttagcatcagaagctttcatgggaccagcggtttgactgattgtgggcctctcattctctcctggacccaagcccaaattcattggatttcatgcctttggtttttcagaattagtttggggtgagacccattactctcctttttagaggatcaaacctggaggatagttgtatccccatgcttagatctcagtgtacacattacacacacacaatgtatatttatggtactccaactcttttgtaaaatacaataggcactaatttttaacatattaggcacagctatttaaagtatgattctgaataaatgtacatttgtatgcatgtgagaaatacatgtatgtgtgtatatatgtgtgtgtgtatatgtatatacacacacataaatatgtgtctccgtggcaacccatacaacactttttgggtttacatagagtctgaacgtagtttgaaatggagctatgaggttttagaagacaaaattatttcattctccttgcaaacctgttcgtctcttagctttgccatgtcaatacttgtcaccaccatgcactgagctgcacaggctggaatcctagaaatcaaccttgatttctctctgtagccccacccatcagcaaggtctggccactttcaacctgggtctccatcccatctcctctccatctccacaagcatggcccttgatcaggccgctgcccatggcaagagctcactgatggatctcaccttcacatccatattccatgtgatgctttagaaacatacatgaggatcaagactgcacgatctggccctgactacctctcccaagttcatcccctcctccccgcaccatcatggcacttgggcctcagaccttcctcctgtttgacagataatccaggctcatcccatcctaggtacctggctgggtacagcccctttctttgataccactctgaccttacaccctgctgcctgtgcagtttgttatacatgtcccagttcttgcttgcgtgtgaaccctcaccaacagcctgccacctgaaaatttgattccactctttgctctgctgataaatgaatctgacctttctataccaaaaatggcaagaagtgaatcttcttgtctcccttcctatagtaaatagactatatagtagatagactgagtcagctcagagaggaatttgttcaaactagaaagggctcagtatgactaaagagatgactgactatgtcattccctataaaaccagctggcctttattttttatttttttaaaaagagtgttggaaaggaagtaaaaagctcctctgtgaatgtattcatatatacttgattcagtgatggcgttggcatggagacacagcatgaaaggggaacggaaggggtctcctgcactgtaagacatgggcagagacttttgttttctattgtgatccttctaataacatgacatagataaaccgtactcactgggcagcaacagaatcaccgtgctactctgagtgtcttgaaatcaactgagtgccgagggcctctctctctttgtcttttggggtaaggtggtgatggaactggttcagtggttaaaggagggagaatctgggtgggtgaggatgtcagtagcaacaacttgttgatttccatgacagctcaatggtggtgggtcattctgtcccagagccaccactgaccagctctacgaccttcaatatgtcacttgcccttcagggttttggcttcttcatctttagaatgaggaaaagcttcttaaggtccagcctaaagattctcaaggtccgagatctgtgatttatatagtaaaagaggaaggagctcctgggtgacctgaagcatccatccctagacagcagggacattgtcagattccccagaatgcaaccacttctgatgagcctgaagttccagggagcacaacagaaggcttgatattgcctgatgataagtccctagacagtagctgcgagcttgagcactggggtctaatcagacactccagggggaaaggctccatacccacctgtccagagtaaacaggtatggctccatgccctggggttagacagagtcacctgaccagtgcaggcagaaaaaaggcccacagctgctccatagaaggaataggactctatcataaataagagccattgtccccaaaataataatattaaaggtaagggcaagacgctagccagtgcctgccttaggttgcctgtggttcagcctatccgtgtgctgtagtcacaccaattctgaacctgtccacatgcatcaggatgggagttgagcagaaaggccccctgatgtttattgctgctctgctgtaagcccagccaccaggttaacaggccactggtcacccattttatttttcagtcacaaatggacccagaagtgggtattgagtgcatcagaagtttttctagaagttccaacaaataaaacaaagcaaaaaagcagtcagtcaagtaattaggaattcttctgtcctactaagatgcttacaaggaagagtggaataaaagaaacatggcatgtggaaatatgtcaagtacaaatacagcattcagttgttttgctcctgggccattaagaggaggagaactggcattgactggagcccactgtttggcaagaggtgtctggggccttccccatactctctagagtgtggattaacatccatccaagaatgtacaatcctccctattttataaatgagtaaagtaaggcttggaggaagaattagtccaaggaaacaaactgtttgtattgtggttagccagtgtatgtgtaaatacctcaggttcaatcaaacaaagaagtattacgaagagctttggaaaccagtgatgcagaatggagacagggagggataaataatacatggccactgcctctgaggagcctggtgtctcccaaggtatgaactgggaaacgttagaccacagcgaaaagtgaaagcagctttccaagcccccgcgtggagatcagagtgtcccaacacgtggctgttctgatgtccattttgcagatggataattaaggctcagagaggttaaatgagttgcccccccatgacagaagtattatctcctccatgttagaggtgaggaaactgaggcacagagaaattaagcaacttgcccaaggcatgcagctcacgaatggtggaactgggggttgactccaggctatggggctccagtgttccagtggtggggagggcagccctcttcccatggcaatggcttagaaggaagtccagccttgagcagtggacatgttgtttgatcagttttctcagcttttgatctagacgacggatctaagaacaacgttccttgattcctgtatgcagccaggggaccatggatagagacaaggactatggctctgccctcagggcccaatcagccagcctcaagtcaagcacaaagcagggctggatacttgcggaaggccccgcagccctccatgtccagacccctgagtgcttgggtctgccctcactgctccctcatccacaaggggcattgcatccccaggactgtctcagcctctggtgcccaagtccactgtggttcatggagtcaccaccacagtggggccccatcttggaaatgagcccggctgtctctcctggaggagaattcctggggtagctatggcagagcctcccatcaagccattcacctgagttcatcttctggaaaagggcagacaacagaggatcaaaaccaagcatccgttttgctacctttggcaagcactcctgagtgtctgcagaatggggagctcagtggtaggtgacacgttcagagctgaaagactctgcccatggagcacttgcaccagacactgtgctcggtgttccacacaccgtcttattccaccctggcaaccctcagagctaggtaccatagagacctgaaagtcacagaagtagggtaacttgccacagctgaaagataggatattaattggtataaagaggtcagcacaggctattgagagagcacattggcagccccctgattgggatgtcattcaagatatttaataactggaggcaacagagacgctgatcaagcagacagatatcagctgtcaacatccagttcagccaaaccaacacatattagctgaatttcagaactgcctgattcttcttgggcacagcatgagctacctttctggatatctactgctgcattacaaaacacccagtatttaatggattaaaacaatttgttatcagtcctgggtctatcggttgactgcactcagctgggtggctcctgcttcaggtctctcatgcacttgcagtcagacaacagctggagctaaagtcatgtgaatgctctatggggctgaacatccatgatggccccattcacacagctagtgtctctatgcttctccaggtggcttctctctctaacagaggaggctgaatggtttacgcagaagcttgaatctccaagaggcagaaagcaggggctgctgggtatttcgtggctacccctgaaactggcccaccatcactcccgcatgcccagatgtaagaggagttgcaaggtcacactgcagaagagcaggtgggatgcagtgataattccatggccgtctttgaaaaccatctgccacagcaaccttagaagaagaggcaatacctatgtggagccaggtgaaggggtcaaggaagggtatcccaggcagcgagacactatgcagaggcagaggggagagagaacaccaagcacctgtgcttataaatatagggcactcactgtggctggcatggttgggtcaagatgggagatggcaagagcttgggcaggagagagacttagatctttgagggtctccagtgcctaaggagtttagattttatcccagcagcattgaaagccattaaggggatttgatcaagcaaggagttgacccaaccatatctatatcttggaaagattttgctggctgtaagatggagtagatgaagacaggtagaccagctgccttcccccagctgtcccacatctcaaaagaagagctaccgggataaagccttgttgtagctttggccttagccctgtcctggttcttcattctcatctgagcaacaaggctgcataaaagaacagaagccctggggcagtggtgtttgcagggttcagttgactctatctgttatgctcatttgtctgagattccggaagcctttgaatagcacttgtgataattacagaatccccacatatattgatgaaaaacagctacataaatagcaaagcttggtatttgtgaagtgccagttttctgtaaatatagaatgttggcagttactgccgtgtggtttgtctactctctggagccagcactggttttattacagccctttccagggagggttttatatcctgcctacctgtggccagtccactggcctcacaggtacaactgcaaaaagcaacaggcaatctgagaccaagagaggcaatcctcaatctcttttaagtgtggagagtcctgtttgacatccaaaaaggcttttctgttgttgtttttttgttttgttttgttttgtgacggagtctcgctctgtcacccaggctggagtgcagtggcacgatcttggctcactgcaacctctatctcccagattcacgtgatcttcctgcctcagcctcctgagtagctgggattacaggcatgtatcaccacgcctggctaatttgttcgtatttttagtagagacaaggtttccccatgttggtcaggctggtctcaagctcctgacctcgtgatccacctgcctcccaaagtactggaattacaggcctgagccaccatgcctggccccaaaaagtatttttagctattcctacatctatgtgtagagacccctgactgctttagtaagttgaggctccttagcaagtgtataaggtacagattggaaaccaaggcttatttgtagatctagaccagcattttccaaactgttttctcaggacactagtgaaagaatgataggtattgtataggtattgtatagaaaatgaggatctcttaatcaagtgtttaagaaatgctaacttactatgtattttctaaatgcagggtttctcacaaactttaaatatgctaatttgggccatgattctgcacaaaggaagtgtaatagctgggttttcaaaattgaccacagaactctttttaacagagtattttacaggagtttggaaagaattctactttgagtaatgatgactaaccatcctcaaggctcattaattgatctcagctcagctctcaaaggagtgatattgtatcagttagcttttgctgtgtaacaaatgatgctacattttggtagcttaaaccaatggctatttttttaactcatgattcccttggtcagtaatttgggctggactcaactgcgtggttcttcttgtcttggctgcctttctcatgtttctgtagtcagctgtcagcagttagaccagcttggttttggacagttagttggctgtcagcttgggcaatgagagtaactgagtcacatgctctgtcatccttcaccaggctagccaagtttattcacatggcagacaaacagggttcccagagatcaattagaagctgcaggtcatactgaggcctaggcttaaaactgacacaacttcccctccagtacattctattggtcaaagcaattcaaaaggccagctgctgtgattttcaagccaaagagaaattagcttgagaaataggggcttccacattttttataagagagtcttaggggaggtgatttgcttgagagagaagaactggggttatttttgaagttgtgtctgcataacaaacaaaaagaatcttggacctagattgcatatttatttagggtactgggagggtgtcttagtccattttgtgatgctataacataacatcacagactaggaaatttataaacaatagaaatttgttaatcatggttctggagtctgggaagtccaagatcaagaggctggcatctggcagggtccttcttgctgtgtcatcccatggcagaagggcaaagagaggaaaagggagagagaagatagggaggctgaacttgtttatttgttttaaggagcccaccctcacaataatggcattaatcccctcttaaaggtcccacctcttaatttgccacattgaggatcaagtttccaacgcatgaactttgggggaagcactcaaatcacctcagggagagatgccgctgatggagattatgtggggctaaaaccacccctcaatccactcctcagtactctcattggaagtgagtctaaatttctctctctcaataaataatataccaaaagcccaccaactgaagatgactaggaacatatttgtagtcatacacagtacaatgtttgatttttttagcaagtgcaagcaaggttagacctgcccagaggaactttgggagtgtttctgtaaggggaagattggctttgggatgcatgactctgaggacagatgatggagtggggcaggtctgggttggatgctgctaaaaagtgggggtaggccatactgcccaaggtaatttatagattcaatgccatccccatcaagctaccaatgactttcttcacagaattgggaaaaactactttaaagttcatatggaaccaaaaaagagtccgcattgccaagtcaatcctaagccaaaagaacaaagctggaggcatcacgctacctgacttcaaactatactacaaggctgcagtaaccaaaacagcatgggactggtaccaaaacagagatatagaccaatggaacagaacagagccctcagaaataatgccgcatatctacaactatctgatctttgacaaacctgacaaaaacaggcaatggggaaaggattccctatttaataaatggtgctgggaaaactggctagccatatgtagaaagctgaaactggatcccttccttacaccttatacaaaaattaattcaagatggattaaagacttacatgttacacctaaaaccataaaaaccctagaagaaaacctaggcaataccattcaggacacaggcatgggcaatgacttcatgtataaaacaccaaaagcaatggcaacaaaagccaaaattgacaaatgggatctaattaaactaaagagcttctgcacagcaaaagaaactgccatcagagtgaacaggcaacctacagaatgggagaaaatttttgcaacctactcacctgacaaagggctaatatccagaatctacaatgaactcaaacaaatttacaagaaaaaaacaaacaaccccatcaaaaagtgggcgaaggatatgaacagacacttctcaaaagaagatatttatgcagccaaaaaacacatgaaaaaatgctcatcatcaccggccatcagagaaatgcaaatcaaaaccacagcgagataccatctcactccaattagaatggcgatcattcaaaagtcaggaaacaacaggtgctggagaggatgtggagaaacaggaacacttttacactgttggtgggactggaaactagttcaaccattgtggaagtcagtgtggcgattcctcagggatctagaactagaaataccatttgacccagccatcccattactgggcatatacccaaaggattataaatcatgctgctataaagacacatgcacacgtatgtttattgcagcactattcacaatagcaaagacttggaaccaacccaaatgtccaacaatgattgactggattaagaaaatgtggcacatatacaccatggaatactatgcagccataaaaaaatgatgagttcatgtcctttgtagggacatggatgaagctggaaaccatcattctgagcaaactattgcaaggacaaaaaaccaaacactgcatgttctcactcataggtgggaattgaacaatgagaacacatggacacaggaaggggaacatcacacaccggggaccgttgtggggtggggggagggggagggatagcattaggagatatacctaatgctaaatgacgagttaatgggtgcagcacaccaacatggcacatgtatacatatgtaacaaacctgcgcattgtgcacatgtaccctaaaacttaaagtataataataataaaatttaaaaaaaaatgggggtagtttggtaattggatatctccatagtatctgtccaagatacagtacatgttaagccacggtgtggtttccattggtaagaaggtggcaacggtcactcaaaagcaagatgttggccattttagggttgaggttcagccttgtctatgtcctgctagacatgtttctcaggatccactggcttgtgtagaaacatcaaaattctcttggaaatagtgtgatttgatcgtcagtgggtagattattgtttcatcacagaccaggatggaagctggtcagcaagagacttaactatagatagagatagagacatccaataaaggatgtgtatccagagtatatatttttaaaaactgttaaaaatcaataagaaaataacagacaactttgctttttaatgaaaaaagcaaaaagacttgaacttcatagatgagaatgttcaaatggccaataaacatgaaaagttgtttgacttccttattcattagggaaattcaaattaaaatcacaatgtagtaccactatacacccaccaacatggctaaagaaagacgagcaaaaccaagtgttgacaagtatctaaataaagcaactggaattctcatctgcttctggaggaacataaattgatgcactcactctgtaaaactgcttggcactaagtagtagagctgaacatatgcatgctccctgatccaacaccactactccccgaatcaacagaaattcatatatacatgcaatgaaggtactagaatatccacggcagcactgttcatgccaagcactggaaactaccaagctgtctctcaataacagaaaggataaactgtgctgtgttcaaacaacagaatgctatgcaacaatggtgataatctaccatgatccacaactgcatacaacaacacggttgaatccatgaacacaatattgaaccagacacaaaaaaagtatgggctgtatgatcccacttatattaaggtacaaaagcaggcaaaactagtcagtggtgatagaagtcaggatgatggttagagactgtggggatgtgcaagagcttctggggtgatagttacattctgttgtttcttgggctgattacagattacatagttatattcactgtgtaaaaattcattcaaggtattcacttctaatacgtccattccaattagaaggaaacataacatcagaatccttgtgttgctggtgacatggcagctctggccacactggagcacagtcttcctcctgccctccccacctctgggcagcagctgaaggtgaaatcctatgctggatttcagctgggggcagggttccttcacaccttccaagttggcagagacacagctttgagcctcgtggccttgtgtggggtcgtgagcttagtctctggagccagcctgcctgcaattctgctgactaataaacatctgccctcataacactgagacacagtaagcactatatttatttttgccgttattttctgctccattttacagatttaaaaaactaagattcagagtggacagatgattttagaggaagaagggggagacacctttcctccccatcataagggtctcaactgacactcctataacaaatgtcaggttaacaagagaaaagcataacaaatgtatttaatcaagtttcatgtgacacagggaccttcagaaatgaagacccaaagacccagggaaaattatctgttttgacacttacgtttgatgaaaaatgggcagccatataaaaatgtgattggacaaaaagggtgtaatctaatggcaagagattaagggggaaacctagcatgcctgtgtgttcagcttcttcttagcctctctgacttggattttttccacctaaataggaggcagaactcttctggaatgagagtcttcaagggagatggagagggagaaagtgacctttcggaattgtatggcttgcttttgggagagacctgttttgggcaataggaattctggtttctgtggttcacttggcgggagaagagggatgggagacaggagggcagaaagtcagagagaacttgcttctgagccccttccagtgtccttcggttcaaagtactcagcataccaaggtgccacacttcgggatatgatgttctgagtcccagcatgacccatcccaagccatgcagtaaaacacgttcagtgcagagctgcaactgggaccagcatctccttgactccagaacttgtgttctgaagcattcagccctttcatcaggaaggggagaacaaggaacgcagggagtggtgctcctcgagagagacctgctctctctgccatcgctggaacagccagaagcccctgaagccctccacacaagggctctgcctgaacacccattttttaaatgcaaactaattcttcagtctgccttggaaacgcaaaagctgttcttttacacaaagatgaaaccagcaggctcgcagaggccagtaacacccactcccctgcatcataagttccaaacagtgtgtgagggacagagccagcgccacggtgaggagtaaacatcacacacgccacacgtgggtggttagtactgcatgaagcccaggggaggcccatttcctggcattctgcttctatgttttagtcagtgctgcattcatgggtaagtttgcatttgatttgctttatttccaaaattatttccagcaatggaaagggaagtcgagaggaaaaaaccaaaacatttcccatcttccgtccctttatatagggcagccttagcccactcattacatcaccaaagatctattgcaaatgtcagtgaaaagaaaatctgttttgataacaatgtcactttagatgtatttgaaatgtctaaatgttggtgcaattttgatactaataatcctccccgtgtcccaaccctactttttgtggataaccccgcacaacaatccttggtgggaatgtcagatgacgacttgaaaggcaactgctttaagaaaaccccatacacacagctcatgtgttcttctgatttaaaagcagctttttactttagtctacatttgtagtggacatatttagcttaaaccttacagcaagatgtacctttcaggataaaacccatgtggaaacctttcaggcagaaaagaatggcttgtatggaagtcttaatagtaatggtaataacaaggataatggcagcggctgcagcggggagacgtctctggaagatgttggagctatcctaacactcctccatccccattcactgttatctgcctgtcccggaagcctggcttccttctcttctcttttttcccacttttaggaaagcccatgtccaggagcagcctcccttttgttgcctcctgcaagccctctgtattagcacgtgtgtgtctatttacacgcaccattaagtgctgtccctcagttagaacaggtgctgaaggaaggggattggtgtagtctaaggatgtggggcacccccgcgccctccgcccccatccacttggaatcccaaatccctagcatctcaggattgggaagggtctcaggattcatagtctcactcctatcaaagccattgctagagaacttagttgccatttccggaatgctcctattaaactataaaaatcccacctgagattgtaaaaacttttgcactattttgaaaaaagtcagggaaatgtgcttcccagttggcattttagttggccaccctttcggggttgggcggtgtgtgcggctatgggtccatctctcctctcacacattctcgaggtttgcacatccttacctgtaattaattagtcagcacacactgtggtgctcctactgtgtgcactaccagccagcctgtgagtaaggggagcaaggaacagggagaggaaaaagcctcagctcctgcccttccaggttttccaaaccaacgcaataccaaatgagaatccaagatatctcactccacagagtattatcaaatcaaatgaaggggggacctgcagccaggctggaaggtggcattgaaaggggagagatagcaggtggagcagtgttcagaggcaatgcccagaggaggaaacacacttaagttgatgtgaaatgttgaggtcaaggtgaaaattgcagttcaatttatgcagtccaatcttcacctagagaatgtgaagttgggagcttgtgcatgcatatgtttactaggtattgaaattgtatagatgagtaattaatgtgtttgagattgaaataagctgctggtcgtcattttgaaatctgtctctggacttcctcttcattagaatgcaaacctcagggcagggctgctgcatcagggtggtaaattgactggaaaccacgcctaggacttccaggtgaaatcacctgtgttttgtttttgaagttgccaaggtttattttcttcctgctgtgttgttgttgttgcttatgactgcaagatgaacattagagtatcagtagaatctgcgtctgggggctgatagtcaccccagaatgagagctgcctcccaaaatgaaagagaaatgtttcagcatatagatgccagctgacacgtctttgctactgtaattccataagtgttcagcccagattgaggctgtgcctaaggaaaaatgaaaggaatgtacccaagagattgagtattggtggggggctatggagaggaagggatcggagagcccctctgagatcataaacccatgagagagaaggaggagcctctttcagaagacaaccatacaccagacttgtttggacatttatccagaatctccaggatggtctatggagttcaggctgacctaattctccttaacagagtgacctagggagggttactactgtcccacagattcagttttagcatctgtacaatggggataatgacaccaaccatgcagccttaaagaaagggttacattaaggtatgtgtttaaagcacttaggaggaggcctgagacacagtaagtgctcagtacacatgggatttttattataatgatcatggccttgtctattcctcaaatgagccagggaggttcatctcactgtccccattatacaggagagtaaaaaagagctttataaagatcaaaaattccattagatgaaatcgcttcttcaaggttatacattcagtgagtgacagtaccaggaagtagccacatgcatgtctaatcctcacgtgggtgttactacccctggagatgagcctatggcaaggaaagaaaaaaccggataccagtggttttttgcagagaaagtgagctttgttttgaaacggcgtgtcacagacaatgttggcaaagccaaggatgctaggccataaatttgagcctctggagggcccgaactatgtagcatttattcagtgagtacttactgatatcctataatgtgccaaggtggtgctagtgttgatgatgcaaaagtgagtgaaacactgaagcagagtgcagctgccaggccggggagggaggccaacctgcggtgctgcatgagaggtctccccacagcagcagagggagggagaggtccactcccaccgggtgggagggaagtcttcacataggccacagaggaagtctggcatcttgggctctaggatgaaaacagtcaccatgctttgtgcgtagccaacccccagtatatactggttgaattgctaaataaactaggtttcttaaaggtggtggtacccttatttgcaaaaaggatagcaaaactctgaacacaagaatccagtcctgcctcgggtacaatttatggctgtaaagaatgaggtttatcttaacagacattccataatgtacaccctgaaatgagtgctgcctcctttggaacagaatcctgagtgactccacatttattcctgtgattttgcctttatcccaaacagttttggaactcttctttgtcaggtgaagagttttgatgtttacaggtcccaccagaaagtcaaactcaatttgttactgcagtcatacttcatttctaaccaaaaatatcatttcccagcctgactgtccacttgattcatgtattttacctccgaagggtttttagaccattttccaaattcaaaacaccctctaaggacctagtttgccacatttgaagttgttagaaaggataagccacaggctctaaaagcaattccaaagaacaggagcaacactacagaaatccttcctcaaggacccctgagaggtgcccagtgtgcacgtggccctgtagaagcccttgaaaagtgagaaatagaccagcatgaaagatacacccttttcattctctgccttagttctgagacattccagctatccagatgttacacagcaagagaatcaacagagagctcgaaagaaaaaacaaaataagcataaaagtaacgtgaaattctagcgcttgtgtacagatgtgggaggggaagcctgactgagtggtaccatttttgcaccagactaaaattcacagggttaaagattgtaggagggaagattgctcatcataacacccactcttcctctggggcatttttttttagcaaagcacaataagaaaattaaaaatctgttatgcatctgataaccaccagtgcaaaattccgataaaaactggatttatacactcaagcctgagattcaagtgattcctctttctctctccacattggatccaagatggcagttggcaaaatggacctgacaacccagatgggacagaaagaaagggagcggacaggaacccaaggcagtttgaatgaagcaactccaagcaatagtaaagcatggccaccatgaacttgaactctgacctcagattagctttcttatcggagccaataagggaaacgagcagggaaatagaagcgtggaaaggaaatgcggcctcctcctagcaccagatccaaggattaaggaagaataaggctatatgggcatattcataatttttttaaagatttagtagaagatagatcacacggggtttaaaaacaatgcagctctattgttttgcttccagtgtttactaggctccaagtggtgagaaggagaagtgggacataaacatgggaaatgcatgaagcggctcttaactcaatatactcacagtgtgggtgagaaggcagcacataagtacatgcaattatccagctctgcaggagcagatatgagttcgtgagcagtccagacagcaagtgtggacaaacgcaggtcgggaggagaggaattccctatttccatatggatctcccaatgctcagcttctgcaagactcctcttcagaggtgctccccctggagtcagctggcctggcatccgcacttggacagagctgctccgtgtatgcagattgggtttaatgaagaccagattaaatggctgctttttttcggactcttgctcccatgtggagttgaaaggaatcagacaactaagtcagccacaccctctggccctgggaagagagtgatgttagcaggtccctctgagataggcatggggacatgggtctgggccttgctgcgttgccacccctcatccccatcttctggtctaatcacaagaccacctgccccccactggagcatatcctgcagtattttcccaggactgggacaaaatgcaatgactggtttggaggcatgtaccttttcaggttcccagaggagtcaaagaacagtgtaagttttgtttttgcttttcctgatgtaaatggattgattcgaatagtgctttcatttctttggacgtaaacaccattccttataataacccataaaacaggtcatcgaccggccaggcatggtggctcacacttgtaatcccagcactttgggaggccgaggcgggtggatcacgaggtcaggagatcgagaccatcttgactaacacgttgaaaccccatttctactaaaaatacaaaaaattagccgggcatggtggcgggcacctgtagtcccagctactcgggaggcagaagtaggaaaatggcgtgaacccgggaggcagagcttgcagtgagccgagattgtgccactgcacttcagcctgggcgacagagcgagactccgtctcaaaaaaaaaaaaaaaaaaaaaaaaaaaaaaccaggtaatcgacctgagccttcttagtgctcccttctccaggacgcaggatgtggctgaaaggagtatcttgatgctataatgagtcttcatcctctctccctacacccctgagcctgtgtgggaacccagacctagaagatgagacaaggctttgcagtgactgccagaaactaggccacattcctgtgacaccgaaatcctttccttccttctcccatcttttaaagtaatagattacaaaccaaatctcatcaatgcctaaaacagagctgcttgacagaagtgggctggaaggaccggagccctgctccctgaaccccatcaccctcatgtctgtcccactcttcacctcctccctgcaaggcagctgcatagaatgttgacaactggacagcatagcttgaaaatgctgcctcctttttttgaggggaaagggggtggggggcagactcgcaatttttaaggtcctttccaatttggagtttctctgattccctggggcatagtcacataataccctcaagccatctgctcatgggagtaaatccagaacttgccttcccaacctggtttctgcctagaccactgcagtcaccctgcctccaggaggggcagctctggtgcattcacactccagagtccaccctggggtcaggctgaggaagcatcccccacgccttccctttccacccagccactgcatgcccacagggtgctccaacaactctgacctgcttccatttcttcagacaactaatctctttggaaaattaactactgctcctccctgaggtctcagctgagaggtcccgctctctgaaggtgtttatgaccacccaggtcagattctgtgtcctgcctgcatgagctagtctccctctgcactattcctgtggtagctattatcacaacatgtaattatacattgtggcattatttgattagcatctttcttcctcttagtcttaatctacatgaggatagggaccatgtcaatttcattcatcattccaaccatagggcctaatttagtgtgtaacacaccatgaatgtcctataagcattcagctaagtgaaagaggctaggtctaaagttctagatgctgtatgattttagtgatatgaaatttctagaaaaggcaaactaatgaggcaaaatgctaatcattggtgacctgaagatgaggataggagtaaggactggctgcaaatggacatggggaaatattctggggtgatggaagtgttctaaaactgggctgtggtgatagttgcatgatttcataaatttcctcaaaatgacaagtgtacacctacaatgggtggattttgtgatatgtaaattatacctcaataaagctgttcagaaaatgaaatgaaatgaagccggatctcacaggtgactgcgttcactcggctgctgtcatatttccctctctcctttgtccagcaaagagatgtgcactatcagcagaagctgagtgaatggccaggccaaaaaaaactgcctctcccaccctccccttgccctgagcccagctcagatgcagatgctgaaactgcagttcctttgatggtatgccagagccagggcaagagaaaaattcatgatgtctaataaccctcatctctggttgcagctctgtcctctctctaattaaagagatctcctttgggcgcagcccagaagtcaggacatctttgcagctatcactgcagagtttagcaaaataaccaagtattgggaactgtggtacagtccaggattttttcccccagatcaaaaatgcccagacaagttttgttatttttagagttcttcttctgactacattattttctcctctgaattaacatggtcttctcagtcatcatgcagaatagttcagtcccagtacatgaagaatgtgggcctggtatcaaaaggggctgatttacaagcaaggctgatgttccgcgcttctcggctcttactgggccagcatctgtcctgagttgctggtgctcatgccttacctggtattatgtatttggatgacccctctgcttacaagtagcacacttgtctcaaattagaagacttggcctccaatgtaagtttttcgttttcccatatgctaacactgtaaataatggccctggaaaatctgtcattaattagaaattttcactatagcagtttttttaatttaacaatgagatgttatgtgacatttgactctaaataggtctgtgcactagtatggtaggctaattgtagtaacaaataaaccctatgttagttttctattgctgtggaacaaattaccacaaacttagaagcttaaaacagcaaccatttatcatctcagatgtcagacacagcatgattgggttctctgctcagggtctcacaaggctaacgccaaggtgtcagccatcaaaggagaatatccgtcaaggcaaatgcctcttacccttggaatctctttcaacagaaagagtccagcctcttttgaggactcccctgactaggttggacccaccaagaataatcttcctcttttaaggtcaactgatgagaggccttgattacacttgcaatatctgttttcagcagcacccatatttgcatttgaataacaccaaggtgtgcacacatcagaggttatcttaagagttctgcctaccacaaatgcctaaatgcatcatggaatgaacataataagggattatttcttcctcacacaaatattccaaggtagttgcaggtcagggcagtagggttagctctttccatagagccaaccaagggcatagactggtggaggccctgctattttcaacaagtggctttcaagatctttctgagccttaacggccagccagcaggaataaaacacagaggcacatgagacaaaaggtctttatggaccaagcctgagagtggtacctgtcactttgcctgctcacattggattaaatagaactcagtcacatgatggcacctaactgcaagggatgctgggacatgctgtctttagctgggtagccacttctctgtgaaggctttacaccatgattaaaagagcatcagtttttggtagatagctagacatacctctaccatgactgaattttagggaaacaatccagaaggaatacatgtaaatgaggtatattgtcctccaagattaaaagttgatattgtagaatcaatatctcaggtctgacctaaagacagatcattttttaaatgtcaacatatgtattattcataatttaattgctcaatgtatttactagattcagcctcaaaaacctttgacttggccaggtgtggtggctcatgcctgcaatcccagcactttgggaggccaaggcgggcggatcacttgaggtcaggagttcaaaaccagcttggccaacatgctgaaaccccatgcctactaaaaatacaaaaattagcaaggtgtgttggcgggcgtctgtaatcccagctactcaggaggctgaggcacgagaattgcttgaacctgggagatagaggttgcagtgagccgagatcatgccattgcactccagctggggcaacagtgcaagactttgtctcaaaaacaaaacaaaacaatacaaacaaaaaacctttgactcttgaaaaaattatatccacttccaactgatgaggggttaaatgattgaaattatcccaaagaatatgatgcaggtcatcaaaatctgagttccaaatatgttttgaacaatagaaaacatgagaaaaactacataaccttccaaaaccattactttgaattgtgacatttatttgaaaataaaacttccagatattttatttaaaggatcttatgttgtttgagtcacacttcatcattatcagtccttcctgtcagggaaaagtgtgtttgggagaaatacaaagaaaagctttgagttgccaagatagcatttactaaatttggtcataaaaaatgttctgaaacttactttctgtatgctgttttagaggcagctcaagaattacagaaatttccttttttctacactcttaatttttctactttatgtatttctttttggctctttaaaaggcaacagattaaaaaaaattagaggaaaaacatttgttctactaatgtgtcacttgagaatcccagacaatacatagtatcattgagctaaaatgtgttgtagcctatagaacttagcacttctctcaaagagagaaggggagacccaatgagagaggcagacatggggtgaggccaatgaacactcagaaattaaaaagaatagttctaccttcttgacttatgtgtagcaactaaatcacaattagagaaagatacatgtgtgagtgtgtgtgtgtatacttgtgtgtgtgaaggtgtgcatgtgtacaaggaaaatggaaaatgcatttctacctagtgtcataatgaaactaggttttcggccaagatattttccttttgcctttgcatatctgtggcctactggacccttatattgtacctgtgtagaaaggaagcctctaagtctagttgagaggcaaagtgccttgaaggccgtgacccattaaggaaccatattgaagaaatgtaaagccaggcagtaatgaagagcatgacccattaaggaaccatattgaagaaatgtaaagccaggcagtaatgaagagcaaatgaggccagaggtgagcacggtaagtaaattagacccaagtgggcagtgaaatctgagagcaaatgagagtggtgaggaaagaggatgagaacgtaaggcacgggccacatggactctgcatctttagcgtgctgtttggccacagggaatagaaacccaacaaatagtggcctaactcctagatgcctgtttctctcaagggaatggattcagaggagccacttcaaaagctagtgcagtgcttctgcagtttcattaatgcatcaagcccgttccatctttccacttaacagagcttctctttggtcctcatagtttcaagacggaagtgaaaggactgtgggagtcaggacctcacatggaataaaccaggaaggcaggaggtgaagatgagaatggaatgcatgaatttgaagttgaggaaggtacagtaggtattcataatgataaggtctactatggtatgattatggaggtgagtgaggttggatggacaagacccttggagaagaaatcaagaaatggagaagcaggtattaaaaagatcatctacaggtacattgaaacctccaaatattaaaacagaagtggtattttaaatgaattatgactcccgcctccccatcccacattctataaccttccattgtcttcatggtgagtgtagagaaataaatgccttggtggagttgctataacatgccatgagtcgcttgtttttcctcatgtgcggtttcctcctagcctcttctacagacctcatattgccctgtgttggagagagtgccaccctttagcctgggctgccatgctcctcggctcctgctgactgagacactctggcagaaggctcttccctcctttcttcccataggacatgctctcagctctcctcccaagtcctagcaatcagctacaagaatctgcttcattactttcatcctccttccctccactgcccggaggaccaggcaggctgctctcagctgcctgatctatcattggggctcaaaatacatcaaactctcttaaaagccaaaacattttttaaaaaaagaaagaaaaccaaaaacccaaaacttgtctttcactgactgtatgtggggctactcacgtcgccactgcttgctcttttatttgcctggaagctattttctcagtttagttacctcccacctaaaagagtttagtttccaagatctacctttagggaaactttttccccgtctttgaatctttcattgttagtacgttcctagaagtatttctgtccccttaaaaaatgtgaaaattgcatggggccctctgggtctcaggcatcagccagaaatgggcaggtgagctggttcttctaagactctctctccagcagaggcaaaagggctctgaacaactcccctcccacattcccaaatcaccaaggacagcccagcctccctcctgtctgcgcaagcaaagctcctccctctcacattgctgtctacacagccgcccagcaactaggggagagaccagcaaatgcattctgctgactctgactttaccccagctttgaattttccaggtctttagaatatagctgctcctgtgtggccatctacatagaagttcagaaaagtaaatgaatcttcctatttcccccaagttaagacacttcttgccattatttgattgacagcataaatcattcctttactgtttgccagctgggtctctgggctccagcaaggaggctgaatacaatttcattatgaaacagcacctgatttcagctgatcccattcactttcactttgaggttaaacaattcaaaagattctttttttccttctttctgacccctctttaaactccctgtttggcgtttctcagctgcctgcactctccctggcctgtaatctcacagacaaaaagtctccctccggtgactcctccagtgtcagtttctgtgacaagtatggacaggattaggtgacagcctacatctgtgtcatcttgcttcatcagaggaaaggggagggggccacgatctgtaaaccacaaccagcaggaatttgtcctgtgcagtgcgggcctgtgattgtcaaggtttgcaaggtccccagactagggacctcgcctttccctcgttccctccatccctccctcctcccttcctccttccctccctccttctttccttccctccttccttccctccctccctccctccctccctccttccttccttccttccttcctgtctttctaaaattattctggcaaatcacaagcagcttacagaacacagggcagcctccgcacctttgtgtgcacgtgtatgtccgtgtgcacacctctgtgtgcacatctctaggtgtgtgtgcacctgtgtgtacacctctgtatgtgtgtgcacctttgtgtgtgcacttctgtgtgtgtgatcaatgtaggtgatgcccagtattcacaggacacttaaaaaccatggggaaatagaccagtttctgtatgtgacttgctgcatcacaaggaagtaaggtgactttcatggtgagtgggatacactcaattcagaaaatgagaaatctcatgtatggaagggtagaatgacctctctgtaacacaactgtgtacacttcaagaggtcatagttcaaattggaataatccttccttctccctcagaacatgtctttcatatgatgaaagacccagcatggtactcagtaaataataacagaatgactggtgaggtgtgtaaaactaatgctgacaaaagcacttggtagcaccgatgctgtccatgtcagctggctgatatggcaactgcaagccttgtaaatgacattatgaagttgaagatgactccaaagactgaggagcaagagggcatgcattggagtgtacaggtgtggctgagactgtttccaaaatgtaccccaggggaaacataaaatatttgagtgcaaaaaaagacggagcgtataaagacacaggccagcctgtgcattttttgggtgaagttgtagataacttacattggcagagtagacaatctgagaacagcaggagggcagtaggcagagtttgtcaaaaggaggaaaacgattcagaaaaggcagaaattgactctaaggcactgaatgcaaaccaagaggaatgaatccaatgataacaatgcagtctaagaagaaataacccagagactggaaattgggtatcctctatccagtatggtggccagcaggcatggatggctcaggcacatgtgaaagtgccaagtttaaactgagaattgctgtaaatgtagaacacatgagatggcaaacaggaggagaaagaaagtaaaatgtcacattagtatttttatatggattccatagtgaatgataatatttggatacattcagttaaataaaatattattaacattaatttcatctttttttaacctctttgaactaaaaattttacttcagaagtagaaatttttttcattgcatatgtagctcacgtgatagttctctttgatggccttactccggaagtgcttctaacagagtttgtggagagaagagaaaaggtggaagagagataatattgtgatggtagaaattacactgggctcagagttcacttcctgggtataggttattgagcattacataatttcagaaaacctcagtttcctcatctgtaaaatatggtgcttgctaataatgtctgtttgacggagttgttgttaagcctaaataggaaaccatgcaaagcctctaatgggataccttgcatgtagcagaaggtcctcaaagagtagttcctttcttcccttcctttcccccacccagagtaatacatcaggggctccagaggcagcaggcagagctgaaataacctcagtgagttctgaatgtgccagctttctaaatgcattggattgcaggagatggggcaagtgaaagaggagcagaaagctcagtggagaagtcagagtttagcaaggactgcagccagtctgcaatgacaaagccacccaccaatttaaagggagcgtagaatggcaacagagaacaagtcctgatggttagcaggcaggacttagaagttccctgtccagttttgctaacagctgctgtcagatacaattggattaagcagataggtttcctattaggtaaagaagtattattttctaattctttgtggtttcgtaaagccaactctgagttagccgtagcctcagcaacttgcagcaataatgaatcttcaaatagaatttagcaaccctgagaaagatgccaaaactcatgcttagtgttgagctaagagactcacaaagagaagaacttatgtacttgctactcataaataagccacccaccaagggacaccagataacagtgaatgtcccaggatcctgaagaggctcagtggtggcagcaaaagcagattatgtcagaggcccctggtcgtgatttgacacttcttaaagaaacaaaactgaggccaaggaattctgatgaatgagaaattcatccagttccaatctactggatttatacttcaagaatggccatatttcttcttccattagtctcgacaatgggaaagaaaaatagatgcatggctatcctagaatggtagacaatccctggattactccaggaagtattacaaaaaccactggtctacagagacttaaagagatctgcttctgctgtaatggcaccagtgacttgttccttccccactgagaaaattgagtctgtcttctatggacctcagtttcttgatttgaagacgattaacagaacagagcatcgtaaaaccagttcccttattttatgcattcaaaagaaaccccatctttgtacatgactgaagaatattgtaaattactctgagttttgaaggacccctctcctccctatgacaaatacaccacaccaagggtttcaaaaacccaagtcaagtaaatgctggtagtcacaaagatgtacaaaaagacatggaatgtgtctcagtcaattcaggctgaaataattaacaaaatagcttagactagtgccttataaaccacagaaatttatttctcacagttgtgaaagctggaaattccaagatcaaggagccaggagatttggtgtctggtaaggcctttctggttcagagatgccacctttttgctgtgtcctcacatggtggaaggggcaaggcagctctctggggcctcttttataaggatattgatcccattcatgaggggtcttccctcatgacctaatcacctcccaaaggccccacctcccaataccttcatattgttgattaggtttcaacatataaatttgggggggacatacacattcagaccattagcaccaccggcatccagagttgcctgtttctcatctccttctctatgtgccttaggcataaggaaaatccaaaaataaaattcttttcttgctagcaaagtattctagtgggaaaatcagtcatggtgttaataatcagtttgtcttattaaattgtcctctctcccaccccatcgtccaaattagtagagaatttagagtcagctgaataatttcaccattaagtcatttaatacgtgtgggttttcttccagcaaaccctaaataattatgctgaattgagaaaaagatgttgtttttagctagagtgtaaaattgtcactgtagtggccagtgtgtgaaaaaaaaaaaaaaaaaagaaaaggcaattttagcttggtggctcaaacaactcagatttaagtcactgctacaaacggcttgtcacaactggttgggacactgttgcccaagtttctcaagtgattagttttgtgaaattcttccactaagtggtattttctctcttaatgcacagacaggactgtgccacatccttactgacctcaaacccaaagtaagagagaaaagaagtctaactagaaaacaacaccaggcaatcatgaggtctgcagacggcttgtggaagctgaatattccttacacttctcaaaacaaaacccatttttttaaaaaagtattcatttccagtggcctaaaatgtaaagtcttctccatggtctgactgctccctgggcctctgctatgtgctgccaatgagatgcccaaggttctctgggcttgtccacagccccagccctttggagatccttcccagtgaggctcaggttcctgcaggatttagaagtctgcagctcatgcactcagcagggcaaactgtggttgtttactcctcctgtcatcttggttcttttgtcctagtgatatcttgacttttctatggcttttatccgctagataaagaggtcttttccacctacaaacacttgtgaaatcctctcccaattatcagtatactgaatcctgccccagcatgtctgtgcagtggtgtgctggagatggcctgggctggcctgcaagagtcaattatgcacaactcttcccaactttgacatcacaggggtagcctccaatcaatcatggtggtagtatttacaccatgaacatcagaaaatgctacaaatcaaggtttcatcccccagtgtcagttactaaacatttgcaagctaacccctatgtccatctattgacaaatcacttcctcaaactcagtagctgtctccaaaaccaccctaagtgtggggaatattcagctcccataagccgtctgcagacctcatgattgcctggtgttgttttctagttagacttcttttctctattactttgggttttgaggtcagtaagaatgcagcacagttctgtctgtgcattaagacagaaaataccacttagtggaagaattacacaaaactaatcacttgagaatcttgggcaaatatgtcccaattgggtgtgacaaatctgttctaacagtgacttaaatctgtattgtttgagccaccaagctgaacttgtccactttcatttttctcaaaggcaagtttctgaaagttagacctaaatggaatgttttgaaatataaaggtattgaaattttccatagttgttagcaataatatcccccctttttaatggagtcataacagaataaatatatttatgtgtgtatgtgtgtacatgcatgggtaggtggatggatgggtggatggatgatgttaaaatagaactaaatgcgttgaagcataacctgcaatagaagatgggggagggaaatgaggatggagcttcccctctttactgtgtcctcatttcagggcccttgaagaaacatcaggttctctgagtcacagtgtaagaaacatgggcttactaagtttttaaatcacctttactgacatataattttacacaaagaaaatatcatttttataaactttttattttttatttttttatttttgagacagagtctcgctctgtcacccaggctggggtgcagtggtgtaagaaactttttattttgaaataattttagatatacagaaaagctgcaaaatagcacagagaattctcttataccattcacccagcttcccctaatgttaacatcttacataatcacagtgcaattatcaagatcacaaatttgacgtctacagacatttttaaacttcaccagttttcccaccaagctgtttgtctggtccaacccaagatcccacagtgcatttggttgttgtctctttagtagcctcctctccatgtcagatccttggtcttttcttatttttaggaccttcaaaattttgaacagcttgggccagtttaagtttgtcatctctttcctcatgattttgttgagtttatagattttcagcaggaataccacagtgacgttgtacagctgtcagcatatcatatcagtacatggtgttgatatgccttattactgatatataatgcttttgagatccatccatatagttatatgtatgtgctgtgtgtaaagaggcagtttattcctttttattaacaagaagaactccattgtatggaagtactaaagttcgttcatccattcactaattgataaacatctggattgctcctggtttgggggtattatgaataaagctgttatgaacatttatgtacaatagttagtgtctacagatttttcatttatcttgggtaaatacctgggagtgccatgtaagtataggttgaattttgtaagaaactaccaaactgttttacaacatggctttacctttcacactcccaccagcaatatctgaggttccagctgctctatgctctcacaagcacttgatattgtcagctttctttactttagtcattctagtgagtgtgtagaggtacctcattgtggcttctatttgtttccttaatgacaaataatatgaacatcttttcatcaccttcttgttcattatctttttgggtgaagtgtttgctcaaattttttgttcatttttaattggattatttcttttgtttttgtgttgtacgtattctttatacatattgaatacatgtacttcataagatacatagcttgtgcttattttctcccagtctatggcctgcattttcattttcttagcagcatctgttggagagcaaagtacttttattgttaagttttgtttggtttcgtttgatgtggctcattttatcaatcttttttctttcctagtttttcattttccttttgtgtgttctatgtaataaatcattgtgtaacccaaggtcacaaagattttctcctatattttcttctagaggactttcaagtggcaacagctcctggtatactttccttttagtttctctacctattcccttaactctaaatctagtaacagattatcttccaccagttaagtgccctgagaatcattaattacataattatttgtaataattatgagaaattttgatgcttttttatcataaatattcatacgttggcttctgtgagcacttgctactcacactcatagtttcagtgctcccaaaagcaaaccctagatgaggacttgggtgaagacaacagtgtgctcataaatatttaacaactggctctcctaaaataaataaataataaaaaccctgacatgtagcatttgcaaatttccgtggtgtaaatactcacatggcaagttttcaactactagtgttacattaactgatttacaacagtcctgaatttttaataattgtctctcatgacagttcatgagatacaagcccactccagcacagccccaggtgcaggtagtttatttgatccccaggagtgatccccaggagtcaaaagtgagggagtgagagaaatgagacggaaaaagaggaagccaacaaaggggggaattaaagagctgataacactgaggacaactggggctcgatcctgcggaagagtctcagaggaactatgtagaccacaactcaaaatcgtcccaaggagggtggagaagaccaggtcactgaggcatcaattcctactcctgtctctctgttgttgttaattgttcttgggcttttaaaacccgggcactttcagggtgctccgcacatgggctgagaaaagttctctagcactggtaggagctgcaggcagaaaagtagaaagtcacagggtgaggtgtgggtaggaagctgtcatgggtaggaaactgccagtgtatcttaagttgtccattgtcagaagtgggcagaagggtacatctgctccctgtaccagacacgttttaaacactggatcactgctattccacaacacctcccattagatccacagtcagaggtataattccctgtctggtgcaaagttgatgataaaatataaccaagaatagggaccttcggtgtccattaaataatgctttctttattggctgatgtcagtggattcaaagcccccactgaccagactctagtggcactggcattccctacaggagcatgactttcatccttctgttccattagtacattttgtattcttcgaagaaagggtaattctttgtcagtccttaaaatatatgtaagtataattaatagaatccaaacaaataatttctccatccaagccacttaataattagaatcatatgtacgtgtggatgaggaggagggttgtctcacaaactgataggcaagtcagattcaaatatttttttgtctccagactatctcactgtggtagcatcttgagctcctgtaagccgtctacattccgggagtatttccgctgacctttccttgtttggacctctgacctaatgtttctgtggttatgtagatcagagagaatcttatcatgacaaataataagatattttcttaaatgcaaaatcccagtctttcttggggcaaaaagaaattggctatggctctgtcttctccactggggaaatgtcccacagatgtggaacagatgggcctagatttagacaccatccgcttttcagttgtaattaacatcggatccaggggcagattggattttaccactgcgttggtcatccctgatgaccgctggggaatcctaaatcatgtgtttgttagaatgtgaaatctggtttgggtttctttggatgggcaaaagctcttaggagtcaaaggaagaaaaataaaccaacctcttcagcacaccactcctatgtgtctgtttctatggaagtagcccccacagatgcagtcgaagaataagcctgctgacctttcctggtgattttgtaaagaagaacatatgcaagcttccctaaatccacttctactcagttggtcccagtttttgaacaagtggattaaaataataatgacccccagcaacaataaaactatctagcacttactgaatgcttgaaacattccagctattgcgctaagaattttgcacatattatccacttttaaaacaaccatatgaggttggcactattatttttcccattttacacacaaaggaaactgaagccttagtgaggtcaaaatagctcgagtcatacagctgaaatatggacccaggctgtctgattcctggtttgtaaccacagtatcgttactaccttcactgacttatttacatctgggcagagcaagggtaaccagctagcaaatttcttccattcctgttttgtaaggtgcagaagagaactgccaaaactcaaagctaccactgtagtccagtctttttataacctcaaggaaatttatttctctcatgcttcagcatgccttaccccagtgtgcctttatatgatctcctggattcccatttgtgactctgcttcttgcttcttctgagccctggggaaggtaactggaagcatgattaaattttagctctctgctttgtagtcatggctcctaaacattggtggcagcatctgcaaactgcaagtgtaggtccttctcattaacaatgagaatatctcacattgttcctctaacagccgtagaaccaaaatgttgtctgagaacatctttctcttgagttctgattgctctctaagggcacactgggtgaacagattgcaagaaggacatactgagaccaggagtcatctgtgctgatgtccaggtaccaaggtttccctggaatacccctgaatttcaagctagcctacatcagtcagagacaaaggagcccatgtgcccaactgagctaattgtctaacaagagaggttttgaacttcctagttagaagtccatagtaatcatatggtaattattttaatgggttgtcattgaagcgtgaagttgaaagtgctgtaataagaagcttcagtatggcttcgttagctgtactaaatcttaagcaataaaaccgaaggtcagagtttaaaccccacacaagtgtgttggctttgttcatttacacacacagcctcagattgggcccctaacccactgccatccagcttgttagctctttgtacctatcatgagaacgatctggctagacaccctaggatgacctagttggcccatcaccgctaatgagaaatcatattccactccaggaacacatcctatgggattaggtcagttctggcaataggatacagtatagagaggcagttaaagaaatggtcccaacctgggaatcttactatggctttcagcagctgggtgcacaaagctagattgtagggtgaccccctgagcaccttctcagggtgccaatctacaatgggcactcaaacatcattataataaactggaaatatggtgttgcttaacttggatctccacgtgacagaagttattatacaactgaagacaaattaatccgcacaactgaagacaaaaagccatcccctctacctgaaggatctttttttcttctgctattgctagcctaaatatgcatataacatatatctcataggtgctcacattgtccccgccagctgagattttaaaattcaacagtgtgtggtagctacccaagttaaataaaatgtgttcactgtctaaatattaaatattaaaacttcaaatacacccacaagaagttgcctgcttgagaaacatacaaaagaaacttgaaagaaaataacaatgaaaggaaaatgggagatattttgcagaattgtttgcagaatattgactatgcttgtgccaggggaaatgaattagtaagaggcttatttctatacacacttttttattaatagaagattagttttctcctccctcctccacagaataaatgttgaataaatatttaaagaatataggcttgaagaggcgccagattacgagcctgctggcgtcctgtgtctcaggcctattctgtttttggaagtcctggttgcttgcccttgattggccagcagttccactgtttgatgttatctggtagcagcaatgtccatcagctcctgagtctgagtttgcagagagaacaagaaagtgacagaaaggcaagaatgcaaaaatcttgataattttaaccagtcttgtatcttttaaaagcacaatgttgggcaataaacattgctgtaactggcacgaaaattcctaccttattgtgataaccctcggaaaggctcaggttactaataagaacctttaggcaagaagtaggtttcttaccaaccttgaagtgaagagctctatcatcttgtagacagttgaatgagttttgaaatttcaaaggcctctagaaaatttaaatgatctaatatttacagtagatacctagacagaagtcattgtcctcacttctcaagtaagcctgaagaggaagatcccagtattggcaaacaggacctctagccagccagtgtttacctgggatcagaagaactcccacagggtatggcactggggtttagaggagtagtagggagggaatatcattgaaaagtgggagagggtaaaagggaagaaagaatctgatgaaccagtagaggtcacgggcattctgagcttcctctcatgttgctgaaagcaatcagggttagattcatgggttctggcttggattggagtcacacaaacaggattgaagtcccatcatcaatgccaccatcatcactatcatcatcaccaacatctttgtcatcgtgatcaccatctcctcctcatcaccattaccgtgatcaacttcatcatccttgtctccaccatcatcatatcacaatcactatcgtcaccatcatcatcaccactactgtcaaaacctcattcattatcaccatcagataaggttcatctagtggagtcagcagtgattcctgttcaagacagataacctgaacttatacatccaagtagcatggtccttcctagaatgaactttacctgttcctccagtctcatctgtttgtgctccctcatacacaatctacatactagcaacagtgaataatttgtagttttcaagataaaccacattaatttttgacaccatgcttttactcattctgttcccttgccacttccttcctaatggctaatgcctgttcatcttctcagatgttatgtaggtatcaattcttccagataatcctaccatattatcttctcactctcagctcactgcaacctttgcctcctgggttcaagcaattctcctgccttagcctcccaagtagctggtattacaggcatgcgccaccctgctggctaatttttgtgttcagtagagatggggtttcaccatgttggccaggctagtcttgaactcctgacctcaggtgatccacccaccttagtcttccaaagtgctgggattacatcgtgtgccaacacacccggcttccatcctctcattctctaagacctaggttaggtgtccctcctctgtgggtttgtggaatccagtaagtctaggtttagctttaatttcaaaggctccgcttacatatgtagaagatatattggggctccattagatccacatgaattctctttccttgtttgtgtgtctatccagcagctctgtgtgctttgctacgaatgtttcacccctacaaccttcaatgaactaccttaggctactagagccacttcaccaggaggcactgagagtgagaacgacctgggaatttgtgttctcggggggtggggggtcaaataaccaatgattgattggtatagtagtaggaaagtccagctgctttgcctcaagttctgtggtgcaatccacattctgtgcaggtgaggctaaggctgaggtgtcacctggcatcacacccctcattggctgctgcttcttccttgtcttgcctttgccactaccttattggtcccccattgcatatggactcttatctgagggtctacttctgagcaacccaaccaagacctcggagcctttttccttgtattgattcctatcacctgagagccaatttccctctcacactaaatggcacctttaaatgaatgaatgaatgggatggtgaccagacaggtagggaattctgcatcttcagtgcctggagtctactgagagtggaggctgtatgattcagatcaggggctttgaagtcatgtggcactaaatttggatgaatgctgactctgtaaatcgggcatctttcttatttcctccaaacataagtttactcatctgtgaatcagagattcagcaggcccaacttctgtatgttggttattgggaaagtgaaatgagctaatgcatatcaagcactgagcccagggcttggcccactgaaagctcattcattcattcattcgtttattcattcaaattccagaaggagtaccaggtactgctctggaactaaggatacaaaagtaaactaaactgtcccaagatcattcaagcaacaaccgggaagccagtgtgcctggcacagaggcagcagcaagggagaaggatctgagaacagagtggctacttagtgtccattactcaaaatcaagagattgtatctagaagcccagctttgcagcttttcttaaagaatcagaagctttgaccacactaagcacgtattctcctgcaacaactggctgagtcaaagatggtcctccactgtccagtgagcagtgggccctacctcattcatttctacattcccacaccctgctgtttcctgtgggcagttgaggtcatggcccaggcagcagcctctgacaacaccagggactcccacacttctcattgctcactgcctccaccctgtgcctgtcattctttccctcaaccacagaatggggataaagaacctcaatcatctatgcctgttcttgtacgaaccaaatgaagacttctactgggtaatactttgaaaaggaaggaaactcatatagatgtaggaggaattaacattccttattctacaagagaggcccttccttggaaaataattaatggactcaaaccaggaaggtatcttcctctagaatcatgcttcacagagtgtgtgtgtgcttgccaggggaaagttgccaggaaaaccaggaaacatttctgcttctccatcatgcttggcagcagggcttcaggaggatggcagtgagaggggatttcactttttcaaaaatgaacttttttaaagacataataacacagccaacaagcgcatgaaaaatgctcaacatcactactcattagagaaatgcaaattcaaaccacaagtagatgccatctcacaccagatagaatggctattattaaaaagtcaaaaaataatagttgctgacaaggttgaggagaaaagagaatgcttatacattgctgctgggaatgtaaattagttcagccactgtggaaagccatttggaggtttgtcaagaacttaaaatagaacttatcattcgacctagcaatcctattactgggtatatacccaatatatagaatagttcacaagtggtccaaaagaatataaatcgttctaccataaagacattgcaggcagcactattcacaaaagcaaagacatggaatcaacttaaatgtccatcaacagtagactggattttttaaaatgtggtacatatacacgatggaattctacacagccataaaaaagaatgaggtcatgtcctttgtagcaacatagatggagctggagcaaattaataaacagaaagtcaaatactgcatattctcacttacaagtgggagttaaacactgagtacacatggacacaaagctgggaacaacagacactgggacctacttgagggtaggggtgggaggaaggtgaggattgaaaaactacctatcaggtactatgcttattatcttggtgactaaatggtctgtacaccaaactcccacaacattcagtttacccatgtaacaagcctgcacatctatccctgaaacctaaaagttcaaaagaaaaaataaactttctaaccaaatccaaaaccatgtctcagtcaccatctcttggcagcagaaaaatagatatattgaccatcacacacacattagagtggctgaaaaaataaattggaatacatcaaaaattaaaacttttgtccatcaaaggacacaatcaatagagtgaaaaggcaactcacagaatgggagaaaatatttgcaaatcgtatatctgataaggggttaatatccagaatatataaagagcccttacaagccaacaaccaaaaaacaaacagcttgatttcaaaatgggcgaaggacttgaatagacttttctgcaaaaaaatgatatataaatagccaataaacatatacaaagatgctcaaaatcagtaatcattaggaaaatgcaaattaaaaccacagtaagataccacttcacacctattaggatgactactatcaaaatatcagaaaatagctggtgttggcaaggatgtggagaaattggaacccatttacactatagttaggaatgcaaaatggtgcagctgctgtggaaaatagtatggcagtttctcaaatgatttaaaacagaattacatgtgaaccatcaattccacttctgggtttatacccataagaattgaaatcggggactcaaagaatattgcatcattcacaacagctaaaaggtggaaacagactgtccgtagacagataaatggataagcacatttggtatagacatataatagaatattattcagccttataaaggagggaaattctaacacatgctgcaacagggatgaaccttgaatatattatgctaagtgaaataagcctgtcccaaaagaggaaatatcatatgattttacttgtatgaagtacctagcacagtcaaattcatagaaaggagaatgatggttaccagagactaaggagaagggaaaatggggagttattgtttaataaggacagagtttcaatctgggaaaatgagaaaagctctgaagatggatggcgatgatggtttcatggcatgaatgcaccactgaactgtagattttaaaattattaaaatggtaaattatgttatgcctattttaccacaataaaaatagtttaaaacatttaatccaaactaatagatatgtgggaatatatacaatatttgtatatgttgatacatccaatatatactgtgtatatatgaacagtgactaaaatagagggagagatagatacagagagacttttttaatgatgcagcccctctcggagttattggcccttccagttccccaactaggtttgctttcctctatcttacttaagaaaacgaatacataagctgacttagaaatggaaatggttcacaaaccccaggaagcagtccagctcaggaacccaagaaagagtgggtcagggaacccttgtgggaggtcagacctgtccagcgtaatgggcctgcccttccctggccagcccccagcacttctgggaggcacaaatccacaggggatgtaagatgccatatcagtgttcttctgcttcctcctcttaacccactacttgtatttttatgtttcctgtgtcctgatgctttgcacgtacttgttttgtacaatgattttatcatgtatgtacttattgagggccttagtacatcggcagtgagggcaaggaagtgataaaggcctggtgtcttcatgttgagttagacttaaggacttgttcatgtccctttcctcatccttccactcctgtggccctcctgtcccacttgtgcctcccatttcctttccatcctttcccaagcttcctgggaggttattctctgctccaacccctctcccattctccattcttctctgccctgctctggacagggagatcagcctctaacgaccttagccccagggctcccacacctctagctttcacctcaactgatgggaagctgtgacaggagaggggagggcaggaggagtgagaggcccagacacttcttttttgctccctcctggctctccagggtctggcggcagctgcttccctccactcctgtgatcatctacatgctcttaacccccttccccacacttaccaggctgcagcaactccgtgtcctcttgcaccttcaggccaaaggttcccgttgttattaggctctgggggtctccaccatctttgctggttcccctaaccctgactgcactgctgcaaataagtccttcattaaattctcttcagttagaaaagagttctctttggtcaaacccttttgagttggcttctgctttctgcccagaccctgacaggtacattagacctccccactattctggatgtatttatctgttctcacactgctgtaaagacctacctgtcactgggaaatttattaagaaagggggtttaattggctcacagttctgtgagttgtacaagcttctgcttctggggagacctcaggaaacttacaatcatggcagaaggtgaaggggaagcaggcacatcttcacatggccaggaggagagagagcagggggaagtgctacacactttttaacaagcagatcttgggagaactctatcagaagaatagcatcggagatgtctgcccctatgattaaatcacctcccaccaggcccctcctccaacactcaggatcacacttcaacatgagatctgggtggggacacagagccaaaccatatcactgaccccttctcaaggagttttatggaagcagaccaggaaatgtacaagaatacccccctgtgtgttcccatgcagcacctggtactggttagaaatggagatccctgggccccaacccagattgctaaatagatcttctggagtgatgctagggacccccattttatctgcattttctggtgactctgggatacataaagtgatatagtaacataggatactttgttaatacattggatagaaggtctagcgttaggtctcatagctacttatttttgaagtaatgatgaacacaaatgatagtttgaggtctgtgaaacatgagtaatatgatatgaaagatctgtgacttctgctggggacatattcccaggttttgccagtattactgtggcatattgcctgtattcatagtggaaggaagtgctgaattccaattagaggttagtgagaacaaggatgtaatttgtttgcatccttagcaaactcacgaattctttttgagtgctctttggaggatagaggggcttatggaccccaggataagagcctcagtcttaagagaggtctccatagaaggggatttgaggcctggtagaggttagagctgtagacgttcctcaagtagaaagcaggcttgtcctcttcctggaatgctgtgtggtgtggtgtggtgtggtggtcaggatttgaacccagtgggtcacctgggttcaaatcctgcctctatcacttacaagtcatgtggcctgagctgctggacttctctgtgccccaggttcccacctgtgaggctggatgaggtccattgtcccctactgcaggtggggaggtaaatggagaaggtgtgtactggaatctcagtatagccctgtagggagcacatcagcatcagcccagctgcacaaaccttgttcccagagccttcattcagagggtttcaaggggaatcagcaatgatcacctgagaaactgacaaccaaaagaaataaatgacttcctcagtaacacaggagtcaatatctcagcaagtggatattgtgaaaaaggcatcttcaaggaggaagagggagagagaggagaaaaagaaggagaacaaaggggggaaagtagaataatcttttcctgctgaaaaatttctccagagatggcaaatctctcattcccaaggctccaaaacagggaccccagtatggtgaccttcaagaacactaaatggtcaaggacacatctgggcacctttaaactcctttaaagtaaaatcattcaaggatttatgttaatggtgcaggtacattcacatatgctcgtttcccttggaatctgagcccctgcaagaaaactatttcagctggtaatggctcccaaagactttcccaatgccaaatgactaaataaccatagggtgggactcaggagaggctcccatgtaccttaggaaggcagttgtttctgagagtggcccattttgatttaaaattgtatttcattcccttcacaatcttccttaactcactcccctcttgttttaatgtgggctctctcagaagcagaccttgagacaaggatttaaatgtaagtgatattggagaagaggaagaaaacatcagtaggggaatagaaagtgagacaggaaagtcaaagctactaataaaaggtacatgacctgagccaggtgcagtggctcacacctgtaatcccagcaactcagaaggctgagaggggaggatcgcttgagtccaggaattcaacaccagccttggcaacatagggaggagccccctccccctctaaaaatgttacgtaaaaaaactagcaaggcacagtgggcatgcctgtagccctagctactcaggtggctgaagtgggaggatcccttgagctgagaagtttgaggctacagtgagttatgatcatgccactgaactccagtctgggcaacagagcatgaccccatctctaaaagaagaaaaaaagaaaaaaacaggtccataaccaagccagcaatgcaacataatattctgggcacctgaagcttaattcagctgggaaactctggagacagcctagagttagcccactcaggggtactgatatgccaactctcaacatttgagggctcccatgggtgttaattttcaagcatttcttgacttctttgtgtggtaaaatcaaaagccttcaaagaaattgaggcattcgctggtatttgaaagtcaacggagctctctaaattaataaggcctgaagaatatagtgaagggaaggggcaccagcagccttctgctacattcctcttccctgcaaacccccaccccaaatcctcttgttcagaacctggactgtgagactgatcatttctctctagtgactagaatcaatgaatggttccagaacaatgatattcacactggtagcagcaccctacagcagacccatggtcagttccaccttgtcctcatggggctattagatacagagcctgtgatcagggaaaataaatttaaaaaaaaacttttatattccaagcttaattatatgtgatcacttgaaactatgaaaaagaggaggaaaaggaagattttattattattattccagccgtgttccctgggaggtttaagatttagaacaatttccaccaaggccacagttctgtagcacttccctaagaattgcttctccacaacaccttcactgaaattaaagacagagagacaggagtgcagatgatgtagtaaaaagaaattgtctgtgaaaaccgctgactgtcgatgcaacataaaacagcagggttaacgtcctgccattcaaatacatttgccctcagtattcagaagcccttatgtggatcaacattccagctagagcctgctcacctctaatatgtcatgggccatgatgatttcctgttatcttaggtgtttttccatttaaccactgtagacaaagttctttagttttattagtctcaatcaacctttgaaattacctgatgagatagtaattatttctcagaatcctgggtcaatagccacttcctcaatcttctccttgcactacctctacccagcacagtatcttctgtggctcacatcagttagggaagcacatggcttcaagtacagagcccccagctaatggtgagtgaagcaagtaaggaagtcctttcctcacatagttagaaatacagaaggagctgatttcaggaattagtccagatggtgcatggtgtcctcagggccctgctgccctcagcatgttggtgtgtatcctcaggcttattatctcatagtcataaatggctgctgccattccagacatcacatccaagttgcacgccggaagatagggtgactttagctggatttgtgctttcttctcattggccaaaactgtgtcacatggccatgactagatccaagaaggccagaagagttgagcatattattacttagaacaagattgaagttgtgtttgcaaaataaaaggtttaatgactaatgaataggccaccaacagcatctgccacattacagaactctgtcctaagatctccacactgagttaaggtgaacctcttacgttgggtacttccaactggacctcaggccattcttctttgttgaaggacagtaacttattaagtcttagacccttcccaccaagcagcgcatctggctttgagttggtgctgcacacattattgttgaattaataaataaataactcttcaaatcctaaggcaggcgtgtctcagaatagaatcatcattttccttggtggcctctgaatagtgcatgctttaaacatataaatgtgatttcagctgagtggagctatccctggaagtttactttgtcatttagtttgttaggaatgtttcaagtctgcttcttggaagttactcgttattgttttttcactgtggctctttttattatctgggctgtatctgttacctgtacatcaaaggacactatcaacatactgactgccacaataatgctgcataacaaatggcctcacaacttcagtgacatacaataaacaattcattggttcatgggtttttctggttcagctgaactgttgaacttgaactgggctgggcctgtctcagttgggctcacccacatctaggggttagctgcttgccagctaatctctgacagccttagccaggacaactgaggtgacctgtctgtaccctgcatgtctcttttcctccagcaggctagcttgggcatgttctcatggcatcattattgttgccacaacaatggcagtgcatgaggggctgcgctatgtctaagctcctttgctcattgcttttcatttacttctcacaacagccttgtaagcactagggagcatgctgtgacgaggcccatgttgaagggtaagcaaagtaagaagagtcacacaaagtcacacagcttggaagtgtcaagtctaggacctgatgggagatcccataccatgccctgggcttcctccaaggctccaggctttgttgcttttagcagctgcttgtgccctgtccctgctacttgggcatttcccttgctagattacaccaggccagctgcggtggctcacagctgcaatcccagcactttgggaggcccaagtgggtagatcacttgagctcaggagtttgagaccagcctgggcaacatggtgaaactctgactctaaaaaaaatacaaaaaaaaatgaagggcgtggtggcacacatctgtagtcccagctactcaggcagctaaggtaggaggatttcttgagtctggtggaacaaagctgcagtgaactatgagtgcactgcatcactatactccagcctgggtgacagagtgagacactctcaaaaaaaaaaaaaaaaaaaaaaaggcaacaccagctactccacgaacaccaccctccttgggatccatcacttcatatatagagagcccatgcttgggaggggtggatattaatatgtgaggacacagctgctgccctcaatagaagggaggccagatacatgaacataaagcaaaagggaggccagagacatgaacataaaacacggctcatggtccaggctacacatgatcaaggccaaagcagattcccactcagagggttctaaaaagttccctgggaagagaagccttgtgatcatgagactaaagctgaaattccaaaagaccacccatcttctctaaatgcctatcattcatcgtttccagaaggcactccacattcacttgtaccggctgctgtagccaagccatgggcttggattccagggtgagttacagcatatctgggctgcctcagggtgttgggccagcccaagcattttcaggagttcaaacctgtctcatattttgtagtgcatctggtaaaaataataatattgataaagaacttcaacggctctgacaggcagccccaaaaagtggatggctggaattctaaaaatatccctcactgtctgcagttggagaagacagctcactagtagatgagctgaacatcagaaaaagtggagatggggtggtgaaccagaaatgatctttatacagggagatagctgggctctgtgggaaggcttggagggagtcctggggtcaaatttaagccctgccatttgctagccatgtgtacttgggtaagttcccacaccctctgcattgtctgggaaatgggaccagtaactccctgcctcatataatatttagaagaactgaggaagtccaggtaatatacctggagcatgcctggaattcctgtctcaacaaacagtggcaaatgtgattattattattattgtcaatgatattaatatatcctttgaaaacataagaatggtcaaagtaacctaaagatgccttactctattaaaactatttgtgctagttgtattaatagtaccatcaatgtcacactcccagtaggttttctgcatcctaaaatttgactttgaacctttgttttcttcctttgttctctttgcttgtgctgcaggaacctgttttccagtgagtaacatgagagagacttagagcagagtgttttgtagccagagtggcaggcccaccgtcaggtgccaggaagggctctgcagctggagaagggctcatcacctcgcaggcctctctgggtgcccagaggtgctatgtcaaagggtatctggttaacagtgagcatccccgcctcatgctgcccagctcacgagaactaacacagcttttgatagtcattaccctcaaaagtcctgagtgcttggcagatctcatttctcatccccctcgaagcgtggatacaacagtgtgttagatggagcttcttgccacaaaaccagatcaatatgtaatactggaacatattcttggtgagatggtttatggacttctaggcagtgttggctgtttcagtgagttgaatatgtcagctatggaacagcttatttagatcttgattaatctacaaatgtgcaattctgtatcccaattacctaatgtgagtgtcctttcaaagctaatcctaaaacctgcatatcattggatcagccaagtcatacagcaaaagagggtttgagtccattgcaatttgggaatgtattttctgatttattcccaggctacaaagtacagcaagaattattcttaattgacattttctttttatttttttgagacagagtctcactctgtcgccgaggctggagtgcagtggcgcgatctcggctcatggcaagctccccctcccaggttcatgccattctcctgcctcagcctcctgagtagccgggagtacaggagcccaccaccacgcgcagctaatttttttgtatttttagtagagatggggtttcaccatgttagccaggatggtctcaatctcatgaccttgtgatctgcccgcctcggcctcccaaagtgctgggattacaggcatgagccaccgtgcccgttaatcgacatttttaataaaaagcccattggcaaataattttgtacagattatgaatagatctatcaatgagttatttttgagatttttttccatgccaagcatcccaggctcctcagaaattagtgaagtataagacagaattcttacctctaaaatctcccatcacctacaaaagttacacaagaaatactatttcagagtgaaaatattacaaaatatagttatggattataaaatacagatagagtcacaccaactgagagagaaatgtagccactattttgattaatggccttacaaactcttatatgcaaatatataatatgtgtatatacacatatacatagattatttaataaaaaaagacattgtaatgctgtttttcatttagcaatgtattatgaatgcctttccttatcacttcatattggatttacacaatcccttttaagggcgtcttattgaatgatgaaccacagtttatataacccattccccaaggtatattttgctaggtttgataacttattgtagtcagcaattttggaatgaaaatactagtgcatatgtctttatgcatttgtctgatatttccacaggatctagtgttaaagtatactttagaatcttacgatcttatggaagagaccaaacatatatgtgaaaagcaaacaagctcatacaaagcagggaccctggggctacgttagtgcaactgctaagggtcaaaggcaacagagatcatttcatgcttgggttgccacagaggcttcatgaaggacagttgcaagtgacagaaacttaaaactgcttaagtgtaaaaggcctattattggctcatgaaattagaaagtgattttgattttagactggagccggggccaggggtcacatggtgtcatttgggacgtgtgtgtgtgtgtgtgcatacatgcttgcgtgtgtgtgcctgtgggtgtacttttcgtgtatgcatgcgtgtgtgtgtgcatgtgtgtgtgtgcgtgtgcctgtcccatctcttgggtcggcttctcactgtgggagcagcattcttctcaggcaagttttctctatatgacagctgcctctagcagctccagatgtggggtgtttatatccataaaaagagggtgtctctgcctcagcttctccacttatctctgcttggccccttacagacctgtccctgactctccactgtgtgacagggcatggatgttctatggctatactgggtcatgtgtgtgcgccctgtgtgaggaggaggggatgtacgactcccatcctgaggagcacttctcaaaaggaaaagatactgggaggtcaataaatgaatgcaatgtcactgctgagggtgctagaacttgaaccacacctattagatgctttgagaagcaagtaacagagacattctaaatcaaactggcctcaacaatgctcatggtatgttatgaagtcaagaggcagggtggacacctgatcaagggctcagtgatgttatccgggggcttaggttttttctgattcagggtcaacttcctctcaagtcagattccttcaatatgactgtcagtggcaatgagggctcccagcttcctggtccacagcaagcaacagagggtgagaaatggctccctttggcaaaaagtaaaagcctttcctgctctctaattgggccaacctaggtcatgtgctcacctctgaaacaatggccacagctaaggaatactacatactgattgaccaatcagcatccactcctggagaaaaggatagggtcaccttccacatggggcatggtggatatttggacaaaactggggtctccttaggaaagagtgggagaaggatgttgagtggtcagtcaacactgaaatcctagtaagatttcattagttggagaggaaacatgcggttggatacagtggagaggcaatttctggccagaaggtagaattccagggaataccctggtcatagctgaccaagatgcagaagcaagtttgcaaagctttcctgcagggatccagtgagtaaacaggttcagttggaagtgttcatttatttattccctcattccacatacctttatggagtacctactatataccaggccctgtgctgactgctgcggatatggcaatcattatatgaaattaattatatgacatcatatcctcatgaacttctggtggaggagacagacaatagatgaattaatttaacatataatgtatcaggaaaaaccaaagagataaatgacatagagagaaatgggagcgggggaaagaggttgccatttgagcagggacctgaagggtgtgatggcgtgagccagtgggatatcttggggcagagtgttcagggcagagggaagaacaagtgcaaaggccctgagacaggaatccatgacatgtttcatggaaagggaagtgggcaaaaggagagtgacaggtgataacatcagagagaaagctgggaccaggtcacaggagagtgttgtgggcattggaaagacttggtatttaaggtgttgaattcatgatgacagaagacattatcaaagcagaaggtggctggacgttcatcttcctggctctgcctcactctaactttaaccccttttatctcctctcttccaggccatatacatgttctatgcgctggccattgtgtgtgatgacttcttcgtcccttccttggaaaagatctgtgaggtacgtgcctcacattcttggtatgtgtgagccagactggggactggacctgtgccctgtactgttccagcctcctcaccaaagtcctggggagccctcgcagggcagctgcagcgggaacaccaggcatcaccatgtttgagagcaatgggcaatattagcacaaaagtgtcatcggtctactgagcatttcatgactctgatcaataatcagacgaaaacccacaggaccaacctccccaactccatttagacctaactaatggtactatttgtgttttccttccccattttcttttccttttaaactcactcttcctttctgttacttcctccacctctctctcctgtgtttccttctgcctccataactctcctttgatatccatggcatcctcgcaggattaaaaacctccaaccgcatacctctgccatgcttcctctctctgtatatgtacagaaatgctccaagcggaagcactgagatgaaagaattggccacggagatcaggaaagtgtccctgttagaaatcatcatagtgcatgccaggctgaacagcaagttaaacccctttcatcaaaaaatattcagcagatctagaactctttcattctcttgcctctttcatctctgtctgtttggaaatgtagcttcctttatctgaaagctttccattttatttatttatttatatttatcggtttatattttaattcagaatccctgtttccagaaggcatctcccccagacacatctgtcgagaactcggtttctttatgccagtagttctcaaaactggttgtgtcttccctttccttctctctcccctgagtacctgatccagtaggtcttgggagagtgggagggggtagaatttgcatttctaatacgtttttcaggtgatgctgaggctgctgcctagtccaggaaccacagacttagagaaccacataccctaagcagtgtcttctacatcctggaagttagtgttggatacttaaataaataaaaagtgtcccacaataacaatatttagagagccacaggaggtgttctcttccacagtagcacagagtaattgaggtggcatctgaaatgcacagtgggcaggtgtggaagccctttgtctgaggaattccacctgagagtggggtcaccttatgtcgaaggggaggaggtgttcctcacctgtaactggagtcctctgtgatctctgaaataccactattgggtgttttattattcatgcagagcaaaacaactctctctctttcccatgcaatttttttggtgtgaatatcaaaattatattctggaaatgtcagtacagttgtcagcatgtgttctactcagttgaggacacagaacctgtgaatacccatgcccttgtagggagaggcaatcaaagagccagaaaatggcaggaaaagagggcaggtgtgagtcttttaacaaaaaagttataaggagaggaaaaggaaagaaaatgtttaaggagggtgaggtgttattttactaggtccctgatatggttcagtcgctaaacagtgtggtgtgactatgtctacctgtctttaatcatctcaagaattctgccaggtgactgatattatcccctctttacaaacaaggaaaccagagcttagagaagctgagcaacttgccctgggtcaagggatagagtcactatttgagcccaagtcagcctgatttccaagtcttcaggcttttctctactccatccagagacgagcctggaccaggtcatggtggtgttagaactggctgcactgcccagacccacagcgatactggaggagtgggcacagaagagcaaccacattttcctgggctctccctgctcccaccccaaatctggtcttataagcaagattcatataacaagagtgggtgccccgtgcctgtctcctggaaagacaatgttggctccatggaccttaaacaaccttaattgctggggaaacattatgtctgtgaatgatgggtgggctgaggtcagagctcacatatatttagagatcctgacatgtttacatcttctaagagacgtggaatcagttctccctggagttacactttctcacaagatgagaggatcatgacgtgggtccaccagcagtggcctggagggcctctcggccctggattctgtttactgcctgtgctttccttaatcaccttttaatgattcgatactctgtgtttcatggttactcgtagactaaaactgggagtggggcagaaaaacacagaaggttgtcgtttccagcttttgtgaaagatgagtggggagagaaatccacactgtgcaacgaatcattgcttggaggtcagggcagattctcgctcagtctcaaatactttaaagttaaaagcagaaaaatgtggggttcaggaaaaggcaaagaaaagaaaatgggagaaagagaaggagataaaggcaatgatccaggatccgaaactggggtcaggcaggccctggtgcttacaaagcacctgctccatgccagccccttcccctgtctggaccttactttctccttgtgtgaaatgacagcccctagattttgaacagtccagagataccattgcagaacgtgcagagagggtctccagagtttagagaaatcctataagccacagtagacagcctcagctgcactgaggcgggaagggagagaggcatttcaggaagaagagtgaacatgaaccaaagcgcagcgagtggaagggcctggcatccccaaggaccatgaggtggcaggcctggccgagcagaggcttgtctaggaaaggtgaagtcggatggggagggtgggaggctttgggacccatgtggaggcttccaggacagcagtgggacatttgagcagcggaggatgtgacaataggtctggaacactactcacccctctgacgtcagcactaagctgggctctgcctggaccaagctctatgccaggggctgggaggaaactagatcacacacagcatgtcccatcccatcccagggctcctagctgcagagcagctccagggtaatatccacagggggctggaggaagtggcggggaattggcaagtgcagaagtgcagagagagagtgggggaaggagagattgacgctgcgagggacagagttgggaggagatcaggaaagggcttgtgcaaggggcaggattagaacagcccttagagggaaggtgtcagtggccaagtattttgaggaagggtatttggtgagagaatgtgtgagccgcaaaaccaagatggggttttgcaccagcatacagggagccctgcaagccaggctgggcgttaggaattattccaagctctggagggagctggggagggcttttcagggctctgtcatggtagataggagtccagagtcaagaagactagagtcctgtgagatattgccagggctgaagtgaactggggatgatggaggggtataagaagatacagaggaagaaacaaactggctggatgaaggagagaggggaaacggacatgaacccaaggtttggatgccacaactaataccccagcaggacagaaccacagcaacacatggctcccgcctcctggcaggtctcggcaaaccatacagggagctgcgagctgtgtcaggctacctcactcacagactcttagctccatgggacaggagtgcttgggcacccctcacagccacaccttgcaactttgcgctatctgcgcctccatcttaggatctgctcggcatcccatgtgaagcttcgctgtccagccgacagcgaagcgacccaggatcctagatcaaaatcctcagttagggcttctcctgcagactattgtgggtcactcaatggaggccagtgacctacatcagggccacaccgcccctctctggctgagcaaggaagtgcagctgtaggtgccactgggaagagaaggatgtcactcaagcttgactgccaggagggaactggctattcactggcagccagcagcatactttctgggtcatgactgaatgcagaaatgcaaaatctggttaccagcctctaatgtataattgccttgtcttcttgtaaatcaccttttggtttaacaaacagagtaacctggagagctcattgtataaaccccgtcttggcagggctgatgcctcattaccttcttttcagccttaagcccccactcccactctctgatcccggggtttccagaatgcctcaaggaaggggagtgggtttcaggagggtgatccccacatccacaccccaacatgcctccataacctcctaaagactcacaaactggttaccatgagcgtcatttagcctgagatcagcatagtatcacaaaaatcaggaagttttgcataaaaggttggattattggcatctcttaaaaatcagaatatctggccacactgagggaactgggcaatgctgcccatagaaagaggtgaatgcccccaccatagcctcagacctaccgcctgctgtggcctcccatgggcccactccactcctgactgtcatctgcacagcccctgcgggaattgggttgaagacccctagatcttcccaagagcctttagctcataaggacatgtagttccctccccaaacctgtcccttaaggaggacattgagaggagctctgactcagcaggggatcggcagcagtggctgcgctctgtgagaaggagaaggaggctgagagggactaagtaccagccccaggtcccatcggtcctactctcgctgaagccccagtctttgcttctcagggcttggactctcgggtgtcacagtcacctctcttccgagatggaatcccaactcacctgtgctttgtctttgctcctctgtagcgcctgcacctcagtgaagatgtggctggggccacattcatggcagcgggaagttcggccccagagctgttcacatcggtcataggtaggtgacagactgagggacatctcagaccttcactgtctgaaggaaaagggctctgggaatggatggcccccagaccgagattgtctgccactcatagaaaatgataatccagggaccccaatgagtagaacatcagcctcccatctgccgttgttgttttatttaagtgatgcttttactgtgcatgaacttgtcccagaccccaagcccatcacactcctgtgcagctatcatccctctgtagattagaaagctctctccacccctcagctgtttcctgtagattctgagaacaatctaatgcttatgaaaggttccccatgcccaccttggaatgcaacagggccacaacagccaggctgatgtgggatctgtgtttcaggggtcttcatcaccaaaggcgatgtgggagttggcaccatcgtgggctcagcggtattcaacatcctgtgcatcattggtgtctgtgggctctttgctgggcaggtaagactggcggcttctttgtgatggcaaaatgtgacattggggaaaggggaggcatggagtttaggcaggagactgtcttgctggaacacaacttgcattagggcccagtggtttgggcagcagtgatttgggacctcacatcccaggaggctggcccagctagaagtggaaactggtaatccaccattacttggtctccatgttgatggaatatagaatgctcaggtccacataaataattaaccagactgaaagatgtgggttacaatctgaagggttccacattcattttggtatgttactgatctgaactagaatggcctaaaacaattttaggtatgatttttgctcattggaaatagaatacatgagaatctgctaaacacaatgagaatacatgagaatctgctaaacaaaacatgcagtcatcacggtttaggacacagcctaaccttttttgactgtggtagagcatttcatttctctattataacgtgcctttggggttatgaagggcttagcaagcctgcagtttacctatggagttgatgccacttccaggtggtgtcctgctatctgagttctttatgaatactggcgtctgttttggaaagtctggggaaggtgctcagaagccactgcgtgggaggctctgggcgacaagcctacactgcagcagcacctggaggtttgtttgcagggtttgcaactgttttgccaactctgatatcctaaatttcttcatagggattttattcagaaacaacacaaccctgagatctctgcccaaatacccacaactttgtgtatcttctagtaaaaggcacttctaaaagctcatggaggctactccacttacaatatcaaggaacctgctgatcctaaccacttgatcagcagccttgatatgaacagtgcactgttctcctagaagtggctgattgggtcagggggctaaggaaagccccggggcagccttccccctaccctttgccagggccctcaccccacagcagcggcaaggggcaccccatgctgcccgttccactgatgtagactcgagggtctccatgcaggataccccgggtccaccattgcattctccactgcccatttttacttccgtcatcttcgtgcctattgatttgtctggattgcctggtgtgtcagttgccttcaggtgacacgcagagggacacctggatctcatcgggattcagctccagggcccacaggtggatgggtcccttctatctggaaaaggggctcccagtacatggtgactgagctctgctcagctccttagactgaatgatttccctcttctcatcctctcagtcaatgagctcatgtcttagattttgtgtacccacaatatgtgctttttaaatctcccataaatgtagttagtatttttttaaaaaatgagtctctgcctttgcctttggtgctatttgcacttccctggctctcctttgccttggacacctgcttgtggccttccacagatgaacagttgcacccagcagaagagtctgtcgctgttagcactctcctaattggcattgtcaccatcagcagtatggttattagtctggctgttattagtgttgtcattagttcattcatcatttgtacctgaagcttgattcacaagcaagcccaaaggaagagagataatgtagagaaatgaaacaaatgactggggagcatctagtcagtgccacacaactaattacttatgaaatggcttggatgcatgtgtggctcatcactcattagtaacgcggttcatcccagcttggttggaacacctgcatcaaaggcaaagggctccctgaactccaaaaaatgctggtgtctgtcccttgactcaccccagaaggtctttgctggctcacctcacaaccctgtagccatggacagaagtaacaaccatgactgttgggagaagcagtccacagtccacgcgatgactctggatgccaacctttccttctgactttcctgtcatgtgccaaactggagattttcaaggccatccagctcagggttttgtaggatccttcaagtctttgcagaggaagcaaaattatgttttgggaagaacatgggctggggaatcagacgggtctgggtttaaatcctgattctgccattttctggctgtggaaccctggagaagttacttatgttctcaaagcctcatttttctcatctatagagtgggtacaagcacacctacttcctagtgttgccatcaagatgaattgtagcatgttcagcattaatagacctgctctacatggtaagtcagtctcagttagacaccattagctatgctcagaatacgcatccctggggttctcacctccaaattccacctaggtcactgtgataatttgaccaactcattgatggaacttatctaacagtcaagggtgtccacagcttaattaacagacacaggatactcagtgggaaggaaagggatagtcagggagaaggtcttctaaatgtaaatcaaagtaaggagatgttcgtagaaaaacagtctcaaaggactagtacttacttctgtgctgtctaccagtgggaggtgaaaaaaaagaaatgacagcttcccagcctcaaacagggagaagctctcccaggcggtggagttggtgcagtggaatgttacggcaaaggctggatattgggaattgaagcgattaataaatccaatcatggatttcacttagcattttatttatgttgatctgcactttcatttggctgggagaattaccagcgagtgcccgtgggcctccctctatgaatttcagcatggagggttgcacatgaccaagtctgttatccatctgaaattaaagtaattaagctataaggtttgagttcctgtctcaattagggttttgatgaattcagtgtaattaaatgtctgctgtatttgcagtttgcaaacataaccctcgctttggtgttcacctaaggtgctttggggagttttatgggacaaaaaggaaattgctttttagaaagtggcttatagagaggttcttggcatcacttcaagacatttacaaggctgtggtcctacaagtttcctttatttaaaaacgaagaataataacaacaaagagaaaacaccgagctcttgatgcaacatactaatgtatcttgtacgttgtattgaagggacttcatgccagttttgtaaaacaatgtacttgtgaatttcgatctgccgttcagagcatgttaagatttaaatgcctaaccacaaacagaaattatgcagtttaactgcatcccaggttaggactttcatattcaggttattacaggccggcagatggctctagtttataataaagagctccaacatcagccctactggcatgcttaaaatgtgcctgatgttctttggcaaggcccatctcatcttggctgggtttgcctttcttcaaataatactggctcgtttaaacaaaccctagcagcacccaaagattgcacctctgaattgaaatccacctgcatttgggcttccccaagagactctaagcaaggactcaagtgcaaacagttgatttgaaaggtgatcccaggaagtgcttgtgggacagtgtggaaggaaggcaaggaagagaaagcagtggaggaaagtgtgttagcaagccagttatcactgtgggtaacagagatctaattcttctgtgggaactgggagacagtttaactggagagccactaagttatctcatgtaaggaggcgggggagctagagtatttctccaccagcttccatcattcattggttaaagactgcacttaagggatattaattccccagcattccagcttgctgggctcaggcggagtggaccttggggcccagggaaaacccccaggcaaagagatctaggggacagcagtggaaagggcctgaaatggtaaaggtggggaaatatgagtgagctcatagtaaaacatttgctatgaactcaagacaaagactttaaaacaatacacttcctgggtctcatcttcagctcccttggatgaaacacaagctttagtactaggcagactataaagtgtctagggccaggacatcttgcatttaaagaattttctctaatgttaaaaataccagctactgtttattaagcttctctaacgttcaggcaccacactagattctgtaaaaatatttgcggaaatacacccactgagttttaagatagttatcatccttctttacaggcaaggaaatggatactgggggattcagtattccccagatggcaaagagtctattgtctggtagttaagactgaatttgagctcacatcagttggttataaattccattctccttccaaaagggggaatctacgatttaaaaacctccagatgttatcattgcattcttatgattagccttggattttatgtgttctttggaagttttgagtgtaggatctggggtcaatgccaagaaaacagacacatcagcaaaatggtggtagcccctgctacaatggaagtattagataggtgcaaaagtaattgcggtttttgccattgaaagtaatggcaaaaaccgcaattacttttgcaccaacctaatattttacttagcacaaacaatgtgcagctagaagtttctcttatactcagatggcatctcccacagctgggcttttgcttccaccacagatggaggactcaggctgataaacacagcgggacacccacaggctgccccagcttaccccgtacaccttgatttctatcttattgttccccagacaaaacccaacacacagctcccctgttccaatcctgagatgcatccagattttccaagaagctggggacagaggacaggggaggccaaaaaccacacacccatagtgctgccaaacctaaaaataggggctggaggcctaacatccattccagggagggagatgaaattgcaaggaagagagcaagtgatctgttgagaaaccaagagggcaggtgtggcagaaggcctcatccaggagccagcgtgcttccgtacatgatcctgtgagtagcagagagcagaatgtgaagtgcaggagtagaccaaggccaaggtcaggtccagctgaggcagccagtgaattccatcacacccagtaaaactgggtttctcccggcatcttctgcaggctgtggcatcaggaggcagattcctgttagaagcagagccccagccctagcccaaggccaactgaatcagaagagcagctcacctgcttcagctccatctgcaggctcagctctcatcacgttctagaccaagcgtggccctggatgagaggcagcctccagcagttggtccaggaaaggtagacagtcctgctgaggccccagtcttatgactgaccatctgcctgaggctgtctcttgcactgtcccctcatagtttcttttctctggccatccccaccccaaccccctcaaggccaggtcctgacagggccccacacctgatctccccctgacagatgctgttggtcccaggcccagagttctgctaaggccacccacctggctctgtgctgctctgttttcattgcctctacaacttcaccccagatctctgtgttagctttgatctgggctcacaaaacgtgtgtcttgcttgttccacttctttgatacgatctcctgaagtcagattcattctcagatccacatctagactaattagaagctttcagtttcaggtaacaacaaaaaaaaaatcccaactctaactggcttcttaaatgaaggaaatttatagatgtctctgaaaaatgcaaaggaaagtggacatcaggtatgacttgatcaggacttccagccccattgttgtgattcttttatctctaatctcctctgtttccttcctcatactagttttttttttttaatggcagaaaatagctgtagcattttcaggcctcaggtacacataccactttggccaggaaagagaaagaggatgtctccttggccaccacatctcattccccatccccccatagcatcatcaaacaaaaatctgattgagccaactcaggttacctgaccatccctgaaccaatcattgtggcaaaggaactagttactcaattggtttaggttaatcaagaaccacatacccatttctcccttccctccagagctaagaatctaatcacttccacctcgaatacacagttttcagtttattataaaaagcagagataaatgattacaggacaaagcctgtgcactatcgtgtgctgcctcaatgtctgctttccctgggctggtggaacacaagggaaaaactgcacacagatgcactctaggtcttgctgtggacatatgctctcatttctttcaggtaaataacctaggagtgggattactgggttgtgtgctaagtatgtttgtaagaaaccaccaacagctttgcaaagtggctaaaccatttgtatttccaccacctacatgtgggattccaggtgccccacatcatcaccagcacttagtattatcagtactattttgttttgttttcattttagccattctattgagcacgagtggcacgtcactgtggttttaatttgcatttccctgacgagccataatgttgggcattttttaacaggcttctttgccatcttctttggtgaaaaatctgtttaaatcattgcccatttgttagtcaggggttttgtcctcttcttattatattgtccaggcagtctctaaatcatcacactcgactaagcactcctctgagtccttctgtccaatttatttccatagccaaatcaatagtgggtagagccattagaaatgatttaaactgatcatggcaatgttttattagttctgtttcttggatttaggtttgcaagagaggtactcataatcagcacggtgcaatgggggaaagaaaatgaagcaatcatttccctttagtatggcacacctggatgtatctgagatgcatcattccagaaatgtgaagagaaaagcaggaacctctcgtggccaggggtgaggactccttccatgtagttttcacatgctccttcaaagtgagtaattttcatgtttctcttgaaactcacttccaaggagcaccatgaaaattactggaaggaatattcaccttctgaaactcactgcctacatcttcggcaaaaattttctttctttctttcttttttttttttttttgagatagagtctcactgcgttgcccatgctggagtgcagtggcacgatcttggctcactacaacctccacctcccaagtttaagcgattctcctgcctcagcctcccgagtagctgagattacaggtgcctgccaccatgcctggctaatttttgtatttttagtagggacagggtttcgccatgttagtcaggctggtctccaactcctgacctcagatgatccgcctgcctcagcctccccaagtgctggacttataggcgtgagccaccgcacatggctggcaaagactttcaatgtacaagttgcccagagtcttaccatcatggcagctgagcactgtcccaagatgagagtccatttttggggcacaaatgtcatttctttccatgacaccacattccccacactgcctcctatcacaggcaagtggggctcttagcaagaatctgccaaatgagcccagggctaattgaaccaaagccaggtcaccccttagcaaaatcacagaaggaggtagagactgggcatccaggcccctctgccccgcaagtagctgaacctgagttgaaggttaagtatagtgaggacaaaagccagtcaggctggcagatgcttgttttatttatgcttccctttaacaagcacacctacagtacttaccttgtggcaggcactgtctcgcagcgttacatatgtgaactcattttgatcctttcaataactcctggagaaagacattgttgagaaaagaggaaaccaaggctcagagaggctgagtactgtgtcagtcacagaaccaatgagttgggagacgttgagggctgcagggatacagctaaacaacacaggcaaagcagggtaactgcttcctcaaggctggctcccagagtcagcttagaccaagggcctcataccctaaagctccctccacagtgtggctgtcctcaacattccttcacagctcagtgccctcttatcaccatgcaacccacttcagtgagtaatcagaggggcacacttgggtgcaaagggactggcagcccagaaaatgccttcttccgcactgctgcaacatgtgacatctgctgagctcgttctcctgctggaccccggccattcactcctgaaccccacaacagctgccgggtgggcccaggcacccctagccttagcacagagacccctcatctccacacctgccctttctgcacaggcagagccagcctgcacaccaagtgaggggaggcgaaggattcccgtcatggccttcgaactccacccttgggcaaaaaagcactggaaagcttcccctggtaaaagggcacacaggacattagcaagtcacaaaagtgtatgtgcagcaggcagggaaggcttccacctctgttccttcgactggtgtccactgaagactccctggtcttccctcctatcaaccccctacacaggtcaccatgtagggagtgacagagcagaccagatttcatgccctaggtccaagcagctacagtccaggtggctatggcctgaaccacaccaggacctgaggcctgagacctcctagaatctaaaaatgcaggcctgtctgtacacaataatgtgaattaaaggtggtttgtctcgtagttatttgtgaatttaaagccagggtcatagtccactgattgtgttctagggagaaatgtttattatagtcttctttgggcagtaagctcattcactgatttaacaaatgtttactgagagcctactatgtgccaggcacagtttcaggcactgaagaggcactagagaaaaaattacattctagtagcaggcttcgagatgttaaatactcaacagaggtgatagattggtaggtaggtgagtgggtgggtggctgagtggatggatggatggatagatggagagagagtaagatattaatatagtgggatagtgggatagtgagatagggagaagatatatggagtcaagtggtggccaatgctatgaaaaagcaatacagcatggtaagcgttaaagaaagtacatgagagagaagttactgtgttataaagagttttcagggaagacacccctgcaagcactgatagcatagtgccgtgaaaaaatattaagacattgcactctgtgaagaaaatggcaccatttaaaatgtagactctgatttggtgcagttttgaacatgagtcactctctgagcagaaggaatgtgccatcccagtaaactgccagccattgcccccaggaacagtgtaaaatgctggtcttctaggttcacaagctagagtaagaaaacagcaaggccaagggcaacaggaagaggcatattcatcgaccatccccaaccctggcaacagtgaaatgcatgatgtgtctaagcagacacatcacgcattttttctgctgagggaatcactgtgctaggctgtgagctccccaagaatgcagcccgtctctgcctgttccttactgcatctgcagcaccaacagtagtgtcacatatggtaagggctgaagcatcttcgataagggcctggctagctgatatcctgcccttgatgcagggcaggggaggatgagtatatgatcagagttcacagggcccttcagctggcacaaacgtgctcagggactattctaggggtgcctgggtagtcagatggatgcatggatgaatgagtatcacaagttgccaccagatacaccaaagacaaggtgagttgaaacagcacaaactctgggtagcatttgagacacagtcatgaaaccgaattattgatttcatgtggacttccattcactgctttttagcggcaggcacaaagcatactgaggtgaacaaaacaggaaaggtttcttcccttctagagctcacagacccatgggagaacacaggcaaggagcatctgaaccaatcaatgatcagataatagaagacaaaagttattgatggaaatgcattgggcaatgggatgggtggtgaacagtggagaaggtggaggaacagctttagcgagggtgatcggggaagtgtctcaaagaaaccccaaatcatgacagcaactccaatcaagatctaggagaagaaacttccaggtgggaagaagagtaaatgttcatacagaagcaagcttgacatgttcgaggatcatggaataggccagtttggagcctggtgaagaaggggagtatggctgggagtgctcagagaggtggtagccaggggccgatcatgtccagccttgggtcatgctgaggatatgggtgcattgggaagctacgggagagttttaagctgttgactaccgttatgcaatttatattctgggaatatcaccccaactgcttggcagagaaaggatactacaggggcatgatggtggccgggagaccaggtaggaagcctgtggtaagacttgagtggcgttgtcagcagtaaagataagaagtggttgctgtctttagaatattttttggaggtgatgccaagagggtttgcaggtcagttggaaataggagtgatgacatgggaaaaatcatggaacactcctggatatttgccctgagcagtataaattgattaagcaatatttgttaactgtacaaatgagtacaaatcgccatgagcaattaggagcttgtgttcagaaagtaggcatcctgttatccaacacattctgaggttgaccgttatgagtcagatccagaaagttggtagggtctctgagtaaatggtgagattttaattaaaagttgttgatgttattcactggccctgcccaacctcctgagccgcccaaccctcttacagtcacagcttcccttggtggcacttgtagtgaaagccctgattggctccttctaggacttcagatacggtgacacctatgtcctggatagcactgcccatctccaggtcaacctcagtctttatgaatttgaaattggcacctaggagctccatagacccctggtggccatgcttttgcatatggtggagcaggacgtgaacaggtgaaatacacagcatttgctacggtgtggattgacccatcttattctctgtcctctgctttctcacaccccctttccccgcccatcttaggtccagctagagtttggatattttatcagactctgctaggctgcaatatcattagcatgtctttattctgtgttccctgagctcctgacaagccttatctctacttgttaatccatcagacaagaaggactcagtttgcaattttattttattttttaataaatacaattttttgctaggcactgtggctcacacctgtggccccagcactttggaaggccaaggtgggtggattgcttgagcctaggagttccacaacgaacggcctgggcaacatagtgagaccccatttctaaaaaaagtttaagaattagccaggtgtggtagttcacacctatattccccactacttgggaggctaaggtgggaggatcacttgagcctgggtagttgaggctgcagtgagctttgatcacaccactgcactccagcctgggcaacagagtgaaataacccaaaaataaaaataaccccaaaaataaaataaaatatatataattttagaaaacacgtatgggatacatatttttgcatatttattaggtacatgtgatattttattacatgcatagaatatataataatcaaatctgggtatttagagtgtctgtcacctccagtatttatcatttctacatgttgggaacgtttcaagtcctctcttctagctactttgaaatatacactacattgttgttcattgtggtcaccctactctgccatcaaatattataacttattctttttacctaattgtatgtttgtacccattaaccaacctctcttcatctcccctcaccccacaccctgcccagttgctggtatccatcattctactttctgcctccatgagattaactattttagctcctacatatgaatgagaacatgagatatttgtctttctgtgcctggcttattttcactgaacatgatgacgtccaattccatccgcgttgctgcagatgacagcatttcattctttgttatggccaaatagtattcccttgaatgtatatgccacatttcacccactcatccattcgtggagacttaggttgattctatacctttgctattgtgaacagagctgcaacaaacgacagtgcagcgtatcccttcaatactgagtttgcaatcttaaaatggagaagtgaaggacacaatcaaaggaaagtttgaggggtgtttttgggatttttttaatatgacagaatacttttctagtcaaatcctttttattctaggccaatctccttttattttttgtgaagtaagacatttgtggcctcctgctgcagctgctctttcctgcaggggaaatctcactctgcatttgaatggaaacctggagcctggacctgagcctgaatctccaagtgagaaagaaactaatgccattaacctttccagatggtgtgcagaccatctagggcaatgggagggctcatgtaccacgtgtccggctttcactggcaaagtaagattgtgttgcagttggctgggggctctccctcccctgacccaaccaagggggtgacatatcttgtgtgtggaagggaggatgagtttcttcttcccttccctatagtgcatatacctgagtgccattgcctgggagaggagaaagaataaagcacactggcctcagtgtgctttatttacttgtgactttctcccacagtgaaattgtgactgcagttggggcatggaaaattagaattagggcacttggtgaggtaccagcagctgggggactcaaggcgtgggtacagctgttagacaacattaaacccctgcccttcgtcattttaagatattggtcattatacagtaaactttactttttccactctcttgctctgtctttgattactgcaacatgcagcttctaaacacatgtgtcccagcctccccatagcatctttgtgcttgacctttttcttaaataaaaatttaaatatatatatatgtatatacacacacacacacacgcacacacacacctttcttttactcccagttgctatttttattttaaattaaaaatagttttcatatgaatagctaatctttactgggaactcagttgagtcgatgtgaaattacatgcatgaactcgtttaatctttgtatcaaccccatggtgtcggttcttctttcttcattgtacatatgagaaaatagagcccagagagggaggttgagaaacataccccaggccacacatccaggaatagcagagttaggatgcagaacaaggcaatttgcttccagaatttgtgttcttgatctctgtggggcacacatgagtcagtggagcaaaacaggacagaggggctcccgtcctggaggctgtagaacatgtctcacaaatggaggaggagggcgccctagactgtcttgcggtccctcccgcgcacctggcggactgcgtgtatgatgtggtccctcccgcgcacctggcggacggcgtgtgtgatgcggtccctcccgcgcacctggtggcctgcatgtgtgatgcggtccctcccgtgcatctggaggactgcgtgtatgatgcagaccctcccgcgcatctgtatatgtatgatgtgtccctgggcctttttggtttagaacacctgatagtgctgagcctggctacccaggtgctcatctctgagtggaacacaagatgctgcctcctgttagacactgagactctattccgagctacgtttatgcatgccctcattatggaatttagcagggattgaaatgtggtgtgggactaaatggaatttgaggcctttctgataccatttcctgatgccaatacgctgtggtgctgggatgttctgcagaatgaagcgtgggaagacgcaccttccctcatcctgatgagtttgttcagcccatcctgttcctggcatctactctctttgggaagaattgactctgtttaagggataaggaggaaagcttgagaggggaacagccaggagattcttctatgacccgcggagtcaaagctcagccatgtccttggtaaacgtgtgctttcctgttttggaaacatgttggcgtcgaagtccttgcagggcttggcttggcttatgctacctgtgaaggtccaggagccaggttgaaggcccgtgggggtcattctgagggaaggcctcagtgctcttggtacagagttgagaatcaggtcagggtggaaaacacgtggctttcacccaaacaggggttgatctcccagcgctcccagcctcccctcggccccagctccagctccagaccctgccagcttggcctagacaaacccattaggaggcgccatttctcgctggactcttaaattctgcccagcggttaagtccagaacacctactaagagtcatcatattcatatgaaggcttcaggagggcctctgagagcccttttaaatgccatcaaaaaagtcagctctgcaatttcatgtaaagaaacaagaatatcatgatcaaatatatctccttaatttttatgacaataaaataaaagaattgtgcacatctgtcatctcacataaataaaaatggattttaatgaagtgctactctacaagtttgaactgaagcaaaatgtttaatataaagtgtgcagctccaattctggccttgggcagagagagtaattgtaaatattagtcatattgtattattatgcacaagcactaagctaagtgggttttgtgtatgtgtgctttcttaaaaatattttagaaatgagttcttgtcctgtcacccaggctggagtgcagtggcataatcatagctcactgcagcttcaaactcctgggctccagtgatcctcccacctcagcctcctgagtagctaggactacaggcaggtgccaccacacctggctaatttttaaaatgtttttgtagtgacagggtctccctatgttgcttaggctagtctcaaactcctggcctcaagtgatccccccacttctgcctcccaaggcactgagattgcaggtgtgagcccctgcacctggccaacgctaagtttttcatatggttctggaggctaactgcccacattcaaatcttggcctccccacatcttgaatacatgaacttcagaagttacttaaccttgctgtacctaagttttctcatctactaaatgggagtaataataatatctacctaatagggttgttgtggtgttgatatatgtttatatatgtaaaacacccagaagacccattcgccttctcctctacctgtgttgccagcaagagtttggcttgggctttctgcccagcacagaagcttgtctgggcggtggtcccaatccactttttcatggggccctcttgcccagaagctccaggtctattttcagcctctgcagctgccctctcagaaatctcctgtttctttggtgccccagttccctggtctgttccggccagcaagagctcaaggagttggaattccctttatgtggggatccacacttcaaaaagaataaaaaagcaacgcacccacaacctatgtatctgcgtcatccctcctccactcatggagatcacagacccagggtgaacccatgctcccccttctgactcctgccctgttgacaaaaccagggaagtcaccaacaccatcctagttgttccacagagagctgaggttagatgtagccctttctcagaacggtgttgacacatgattcatgcaagggctcctgagacgtcagaatgttcacggccatgctacaagccgggaatgtgaatctgagagtcctacaagtctcatctctccagtccctccatgcacagcctctcagctggctctggtctgcagtgctggtgttttccataaaagaggggtgtaagttaatgtttaagactcctattactaataataattgaaacagtaataggagtagtagtagcattaatttaaagttattattattggccaagcacggtggctcacgcctgtaatcccagcattttaggaggctgaggcggacggatcacctgaggtcaggagttcgagaccagcctgggcaacatggtgaaaccctgtctctactaaaaatacaaaaattagctgggtgtggctggcgggtgcctgtaaccccagcaacttgggaggctgaggcaggagaatcgcttgaacctgggaggtggaagttgcagtgagccgagattgtgccactgcactccagcctgggcgacaagagcaaaactgtgtctcaaataaataaataagttattattgttattgttattcctaacatgtattgatggctcctgggcaccgcactttgttgtttatatacattattttatttaatcttttctagagtcccctgaaaaaagtactatcattgtccccattttacagatgaaaaatcagagatgtagctcatcagtgttggtgtcaatgggtggcttgggagagcttttgcccacctactccacacacaagcccccacagtgtccttgctataaagatatgacttcagaaaaaaccctctaccttctcctttacccagacagatgcctggacctcttctttaaagcttcgaaaccacagctggttttcagtttcacccaggtaggaaatgtccaatccaaacttccaacccaggtctggccaactctagaatccaagccataacacactgtatactattatatatttaccaaaagacatacacatctaccaagagagtccccatgctaagcatggcttggcttgagaactccttcttcacaagcatcaacatctaaaggagtctctcatcacgtacatgaaatccctgcttatggctctgtccagaggaggcctgtccaaaccagatggcaaaggcacgggagtccctgactctctctctgcgctaatgagtcagcaggcaggtgtgtggggagttgaaagccagccacatgtccggcaagcagaccactctctgctaccactggaggcatcagccagctgaggggggctcatcacacccgcaccgtggttcagctgagcaagattgcttaggaagagcctggcatgttcacggtgcatgtggagttaagtcctagtaaaacaagtcagggtttcagtctctctggaattgtcaccctgtttaaagtcctgaaatcacacagcgtggcactagtcatggaaccaaagttcatctaccaaagtcccaagtgggatttagaagtaaatgaatccttacatgtaattgagtctctggccctgatttgaccagagttggacctgactcaggaattccctggtcctggcttaacttttgtgggggttttggtctgggcagtcctggccacaccacagcatctgcccgctgaacagatgcagctgtggggtcagacagctcagcagggggtgatggcatatgctgaattttggcatcttcaactttgtgtaccctaatttctctccttttccaaagaaaagagttccgtgtggaatgggggctggtgatggatgtttctgaggttgtttgccggctcttggtgctcacgtatcaagtgggacaatcagagaatcaatggactccataaatagtccggaatgacttcctatttgtgaccaaatccctcctgagtctgaacacctgttcgcccagcaggctggctgttgtcaaaccacttggcagttgtttgaaagcaggaagtcttttctccatcagaagaaagaagaggtttcccataactatcagacttcgggtacatatttcccttcagttctttttttattattccttaaattcattgttcattttggaactaagtgtgctgtctgttgctggccttggagccacattatgcacatattcaaagaaaaaaaaacaaggctgtgagttccaggggtgacacctgcagctgtcctggcatcctggtgcacaccgagctggtgcgtatgagagcaactgagcaatggtagcctctgttacccctgggtctgtgctgagccccatcattcacgtgtctctgtaagggcttcgaaaggaagctcaaggctcccatgctactacatcatgaaaggcagcagagatgtctgcaatccccgggcagcacagtgtggtccagtcacttactccatcggtgagtatcttctgagtgacaattctagggctcggggatatgatggtgaccaagacaggaaaggcccatgctctcaaggtgcttctgtgctgccagagggaaggtagatgatcaataagaaaaaataaaccagcaaggtaatctccagtaggagtggtctgaagagagtaaaatagggggacgtcagggcctagtgggagtgaggggctggcatgagccaccacagatgggaagggaacaaaggcctctatgaagagggaatcttggggctgagaccctagtggtatgaaggaggagccatgtgaagacctagaacattccaggaagagtgaactcccactccaaagccgtgaggcaggaacagagtgactcggttaggggaacagaaagaagaccgctgatgctggagagcagggtcctgggtgaagccaagggctaggcagggctgggtggggggtcctggggccttggtgagcagtttagttgcaattaggacaatgatctaggaacttgcagtccttgggagcagtgataaatcacagagagtagaaaggagtcagaacccccagtgttaacctagatctctgaaggtgctcagtggttctaaactagcttattgtcatggaccaagcattgctaacacgacctcaagtgtgagcctccgccagagccctggatgcctttgagtgttcgctcaaatccccctactgcaggctctgaggaatttcctccattaccctctgcctaccctcctctctcaggagctctgcatccccacttcaaagcaccccaccttccctcagtctttgttccattcctgacagattgtgcaggtggtcaggcttaaccgccttctcctcattgtctaaatctcatcctttttccacaggctgtcagcattcccctcttacaggtgaccattttgattaacggatcccaggctttagcatttgccaccctctctctgggtaccatttcccttccatcccattttgatattagaacactcagtctgaccacggcttatgctattttaaagtataagagttaaattaggaaaaaaaacacgttggcctcatctcaatcctggaatggtcctagatttgggaaactcccagagagtgtgggatggtcaaagatcaagcaaagagattattttcaccgtttgtacaaagtgtatgattgatcagatttacttaaggctccatcatcacacagtttaaccacagctgtctgatgtctaaagacttttacactgtgtttatttccagtcctttctcctgtgattttttttttaatcacttacatctactggctagtctgtttccaattaagacttctactaagctttctctacgaaagaggtttttcttttcttttctttataaaatgcatccttggtattagaacgtaatagcaacatatgagtttctgaagctgaagtcaactgattcttaaagattcttagaatatatattggctgccactaagagattaatgtcaaccccacaagcctgccatatcaattatccctatgtttgttcattcagagctgtaacacgtgctgtctgctttttaattcagcataggccttcttacatctacccattgagtctctgtttagtgacctgatttttcgacgtcttccccagaaagtcacaaccactgcatttttaagcttcagttttccccttgaatcaacccatcgaacgtgccaaaccaaaagaaaactaataaaatttaatagcattgaaaagaaaaacaaattatacctatcagactgctttttttccctaactcctccactcaagaggtttggggagactggaagggaagaggctacacctcttgtcctctctgctctgaatgactgtgcccacttctgaagccaattctgacacccagccctgaattcctagtctgggaacagatattctaaaagcctagaaacatcctcagctttggtctcatgatatcccccagctggacttcctatttggccagcatgagcagcaaagcaaaagaaagttggccaaactgccagtttcccagccttcctctccatcagggcctgtggcagcacacccaaaactgtgctcaatagattcctctccctgaaaattacccaggggtgcaggtgaggcagacctgcctgcctgcctgttccatgtgaacataccactcgccagtgtgcatagccttgtcatgttctagttactgctgcctgagtgctagaggcttccaatatggggaaggatgacatatcatttaaattagctccttttatggcaggaatgattctggttgacattggctcaggcagtgcccatagagataatagcagttggtattgattttattttttattttgtagctcagggtgtttaaaaatgtttggtgctgaaatgcaaaaacacaaaatttttgcaggggattttaagctccagtaaagctctaaaacctctcactaaatttgaatctggatgactgctttgcaaatgatattcatctgactttgatgagtgaatttttaaactcagggaagtaaccgcttctttgtgcataaatataaataggaagcatttgtgaatccctcatatgtaggagggagatgagaaaagcagggacttataggactgagaatgcagagggaagaaggccagggaaggtcatgaaccagaggagaatgcccatggcatagaaggatgtcagaaagcaggaggtccaatccctcattttgcaggtgaatgaactggtggtcagaacagggtgtggcctgtgcaagtccacacagtgaagaactatcaaactaggacttgaaccccactgttctgctttggtcattccagtgtatatgtggacagtgtgcggccaagccatgcctcacacttggtacacctgtcaacccttgtccctctgcagcccctcaggcccctctgtgaattaaggaagagaatgtaggcatagaagagggttggacgtgtgaatgagtttagatgtttatcttcaaggaagccaccagaaatatgagtcagttcacagacgtcctttgagaacccataacatgggacttgcctccttctcctgccctgatccccaattgaaactgattctttagactccccatagttctttttcctggacaccaatccagtgaacaatctcactgtgcatcctctccacctgctgtactctatggaatgctttcttcctcctgaaacccctcttttctcaccccaaatggtagcattccttctcccacagagatgctcttggccacacctccttcaaaagggatggtctcatctgatctcatgacatcagtcccctcctctggcaccccactcctcatccttggtcttgatttttctcccatcctcatgacttagtttacaaatgggtgccagatctttccagcccgggccttctgaggcaggctccaattgggggtctaagctatgaactaaattacttgctcattaatgtaccatttcacctgagttcttctggtacattgggtgcacctttgtggtttctgtcactcagcctttaagcctcagcttcatggccgactgtccacatccagactgctgtcaaatctaatcaattcttccactgtagcatttctcatcctgccccttgctttccaagtccactgcaccatacactccagacctccactcttggtcaactggactgccaaagtcccctcacccctgtctctctgttctttatcctctgctccatcaaattcattttcatactgataaggcttcctgagcctccactctgacgttgcctcttgcctgaaaggccccctttgctggtcacatcccagtagccctttctcatgtctagctgtctttcccctgtccatatctacagcagaactgaactgctcgttgtgtcttacctttgttgtcttacctgtgtgcttgtgcttatgttgttcttcctaaccagaatgccctttttcatctctgttcacttcaacccatctcccaattttaaaagtgcaagtcatttttgtccttcaaatctgtagtctgtgtcacctcctgcaagaagccttccctggtttccccaggtggacacaatcttctcttctttgaactgccatagcaatctttcggttttatcttgatattggtgtgggccgatgatagtctttaatagactcctaaacttgttcgtctgaattgattgttctggtatttgctttctttggtgatgatgatatggagtaagagtgtatagaaaaatacatacacagatgactgttaattagcaacataagatttaaatacatattaaagaccacaagaaatgtgaagttactggttggtaaatgattaccaaatggattgtacagacttcaagatcccaatgcatcattctacaacatgagttaaagtcagtcctttaatatctgtaccatttgctggtgtcttctcatttaggacacacagttctatgagaagcataactaggtaaataacttttctttgcagattagcaatacttgctccatttttcatgtatgctttggttgtttctatagaatgaccgtgtcacaataaggcttttaaaaagaataataatatgttttttaagttgtcaaaaaggagggtgtaatgtataatggaggcagaggttcttcgttgatctaagttcagcattcattatctgaatcactgctgttggcaggttgcataggaaagcaaacttgtcaaaacacacaatattcactaatgatctgaccgctttaaaaacctaggccccctcctactttttttcctgcttaacaatagcatctctccccattcattacataagccaatttttggccatttgttggaaattgtaacattcccataaaaatacaaactgactgcaaactgaaactgaaaatctggcagagatagagggtttcatgaggcagacgtgttgaatgatgtctccatcccacgtacaaaggcattaatgaaggaggctcctgcaattgaggaagaaaaaaagtcaaggatgacaacccaggttctctatccccccaaagaaaatgatactaatattaaaggatcaggatggagacttggaaaacttgatgaaactcttgaatgtttttccccaaactctctttatgaccatgcaggaaaatgaaatacgaaggagggggttattatcttatgttcttctaccattttatggggaaattacaccaaggaacaattaacttggtggcaggacatggttgctcttataacctgatttttttttttcagttataaagacttttatttctgtcctaccacaatagagaaatcttaattttttagtatttatttttatgtatgtatttatttattttttaattttactttaagttccaggatacatgtgcagactgtgcaggcttttgttatataggtatacatgtaccatggtggtttgctgctatcaacctgtcatctaggttttaagccccgcatgcattaggtatttgtcctaatgctctccctccccttgccccccacctccaacaggccccggtgtgtgttgttcccctccctgtgtccatgtgttttcattagaacctaaatttttaagaaaacattaggttcacatgttttgcttttgaagctaaaatctcaatgcaaccattctttacttatgcaacttattcccatttcaggtagtttacctgaccatgtcttttctttaccagctatcctcatatttattaagtttaaataatgggagaagtgtctttctctgaaaaaggactttgagaccacaaagagtttggtttggagctgtgtgcctgtgagtcaggtggaagtgatagcagtaactggaactttgcagtgtttgccaacaaatggaacagactttcattcatcttaggtttaaccacaaatcctctgtttctactcactgagtcaatacatcttgaatcgcagaccaggaaactcaggtggaaaactgctcatttgttttctttatgagctaactacagtccatcaccccaattccagtgaaataaagctttttgtgacagttggtacttttttcttatttttctttcctgtttcttttgtcttcctcggctttcttcttctccttttccttccacttccttcttatcattctcttcattctccccttcttttatttttctttttggttttcattctgttttgtaccaaattgttgtttcagttacaaaggaaaacattgggatctcctaggtacaattttgcttctccaaggtgtacaacattaatcttaaaataaacccgagagatgaggtggtctaccccactctggcctagagacggaacagtggggctgggctgggaccccacagatgcacagccccaagccacatccttaggcagctgcctgccatgcctcttgagggatagccacagaggggattgacaagaatctagggatatcaaatcttggagccttttttctgcatcaagttttgtattccccagaagtaggacctcagacaaagattctagagcagttaatttatttgggataggatcctaggaaacactgagtggggagtgggagagaaagacaaaggagagaataaaggcaaccaaaggtgtgttatcaagcaggtcactgctctggacaccaaggtttgaccccatggtggaatcctggaagatgatggggtacacatacttcagagtggccacctggggggtcagagagctggaatatttgtacaccagctcccattagtcagtgctgccccttgagggtatcactcctgagcacatccagcctggccatgtgagggcagagtgggctcgggccaccagggcacttggacagagttgcgggcactggaagctggaagtccagcccccatgcatggaaagggctggtaagatatacaggcaggaaccagctgtatctgccacacaccacatcacagaaacacactgcagagggcacagcgtccactcttctacactcaggtaggaagatgctggcttcacggatgctaaattcccttttcaacaaggatggcaggaaggggtcctagaaggccaggacagacctagatccaagtgactgcctcacagaaggaaccccatggggaaggtctcatcaatgcactcaacaatgcagattcaacaggcgggcagactcagcttagagcagaagatggatatcattcagcccatctccactgcaagattcctcacttctctgcctttttctcagtcattagagtgaaggtcaaatctatcactggagtggttcttggaacagagaagaaaagaagtggctgtaacccgttgagagattttttgaatacaggagtcagtctgatagctcaaccaggattcttgatccccacttaggactctctaagcagagtagcccatacatgattgtcttcattttcatccataaagccactggacaaatggatggaaatgggaaaatatacctggctgcagcagagcctttggccaagtccagaacctttccaaaggcttttttgactttcaggaattgggatggtttgttccttcatctgcccttccactaaccagaccatcttccagaatggaaatcatagtaagagtgcagaataatctcagggttccaagaggacattagggactattcaatccaaattttctcccaatacagtactccttgaagggtctgttggtcccacacctatcgggctgtgtccctttgcttcacaatcactgcccttagcaagaggttcctgcatggctgagtctaacactgacccttggcctcttcctcctttacataaagcagcctttggcgcacttgttcactcctggaatcgttgcttcccgcagcctccaggctccccgttgccctggccatcctcttacctcccctgcctgcccaccttggttgctttttctctcctccccactgaggtgttatgtcttctgacaatgttccttctctctccacactcgctttcaggcttgcggctttccataccttctgtgcgctgatgaggctagccacccgtccctagttgtctacttgacagtctcaaatatgtccagacctgctctcctggccctccccgcaacatcaaatcttctaagtaaatggtgtctccatctttccagcagctctaacaaaccttggggccatccttggttgaccctatgccccatatcccatgtcaaagctaacaggaaatcctgtggatttaccttcaaaatacatccagatgcaaagttactgctagacgggaggaagaagctctggcattctgtagcaccacagggcgaatatggttgacagtgatttagtgtatactttcaagaagctagaagagaggatttttaatgtgcacaacacaaagaaatgatcaatgttcaaggtgatggatctgctgtgtaccctgatgtgatcgttaagcattgtatacatgtatcaaatatcactctgtatcctacaaatatgcacagttatttaatatcacatgtcaatgaaaagtaaaaggaaaaaaataaaactcaagaacccttaagaaaagtgtgtgtgtgtgtgtgtgtgtgtgtgtgtgtgtaaaataaatgtttttaaaaatacatccagaatctgaccactgtgatcaccccccctctgctgccatctggctcagctgccacaatccctccttgggatgactgcaggaggcccctcagggctctccctgtttctttcctcatctcctggtgggtgctctgtgccccaccaagcactcagaatcgtgtcagaaggtctgagtagagccactccacttacaccctccaccagggtcccattgtgcttagagtaaaaggcaaactcagacttcctcacctacagtccaacccttcctcaggtccctccagtctccctggccaccttgctgtttcccacacggtcctgccttggcacctgctctgactttgttcatggacatctgtgccccagacttccaatgttctcttcctcatgactttccaaatgtcaccatcttggtaaggtcttttgtggtcaccctactcacatgttcacacacgtccccacccagaacccccagttccccttctctgtcttttaagttttaattctccatcctatgtatcatcatgaacatgctgtataatttaaaatctatttgtgtattataaaacttcctccaatgggatgtgagcattatggggcagacagctttatcaattttgtttcttgctctatcctcagtatctgaacagtgcccaaaatccatttggtggctgaatgatggctgaacaaacaccataatcaagtgcctatccccaatggcttatagttcagggataaagagcctaccattttacaaggcacttctattatttttttaaagagttcttttctaaagagttcttttttagagtatcttgctgaattctccctggaatgtgtggcagttggttcagtttctgcattctctgccaaaacaaaatacatctattccccgttttaatcaaataatctcagatcaattcctgggcgtcacttccacctatgatggaaaccgttctctgcctcttggcctcaagacacctgttcctccttgggatgttcacgcatggccaatgtctccattacagagtgggacccagacctggaggatattattctctagaagtgtaatgaacaatgctgagcatggagagatgcccacctcttccccatcacatgaaaaaccttttcacccagatgaaggcttccttggtttgcgtagctgttgatgctcacccttgactcatgggaatgtttgaacagctccagtctccatgtatttttcccatgcaccaccctgttctatattaagatgtgaaattctttgcgttcaacccgcttacaccacccttgtttgtcctggcgcagactgttgacatccttttaaatcttgattctcttatgcgggggctggctctgcctcccagttgtgtatatccacagatctgatgagcagtttcaacagtgtgatgagggtgggacagtttgcatctggaatctttaagagattgcaattgagagtgtgattaagagcttgagatttacagccagactgttgggactaaaatctatctttaccatttgctatctgtatgaagttgagcaaattaattaaattctctgtgcctcagtttcctcaactgtaaaatggattaataataatagctttacctcatggagtaattgcattaactaaatgagttaatacactcagagtacttagaatggcaccagctatatagaaagtactcagtaaaaatgacctgttattatgctcttggacatgcaatatctttctcctagaatgtgcttcatgcagggctgggccccagcccatcctctcctggaagctgtcccttagtgccacaggcccattgattctccttcctccagatattagtttttaccacagaacctggcaaagatcgctttggatcccattccaccgttcttgcccacttagcacatgttattctgggccacaaagatggactgtgggcactggaagagcaagtgccattgcacagcaggttcttattaaccaaagacgcagcccaaattgtagcgttgggagagtgcactcggtgacactgaggcctctgttgttgccatgtggattcaagttaaaatgccactgactctacagctgctgtgactttgcctcttttcctaagtggatccttgacctggatcactctgctaagaacactaagactggtaatcaataatgaggctggattagaaggaagatgaatgatccactgggttagcgtttaacaacccaaattgaaatttgctggtgggacgtgtgtgtgtgggtatgtgtgcactgtgattagtgaatctcttctgtttgctcatcatccaaaccataatctttttgttaaagccgtaatcttttaagctttaattttacagactatgtggtctttagcttcatccttaaacagatctgtaagggtaaagcatcttaaccaccaagtggtttgattccttctcccattggttttgttgttatttggttcagattttcttatgtttttggtgggggaagaggagagtcatttaaaaatatatatatcatggagggatcaaatcagagtccggaagttgtaaatgaattaattaaatgctgtcaccagttgggttctctggaagcagacacgaagacagagttttgagtgcaagatattttttaatcaatacctatgttagtccattctcaaattgctataactaaatagctgagactgggtaatttataaagaaaatagttttaattggctcgcattctgcagactgtacaggaaacataatgctggcatctgttctgtttctggagaggcctcaggaagcttacaatggtgacggaaggtgaagggaaagcaggcatatcacacggccagagcaggagcaagagagagcaaggcaggaggtgctacacactttcaaacaaccagatctctaaaaaattcactcactatcacgagaacagcaccaaacggatgatgctaaaccattcatgagaaatccactcccatgttccaatcagctaccagcaccagaacaaaacaggcagaacaagaggggatagctttgcttgctgagtcttctggctcttttattcttcccacactggacccttgcttctgttcctcctgcccttggacatcagactccaggttctttggcctttggactctgagacttgcaccagtggcttcctggggactctcagacctttgcccacagactgaaggctacactgttggcttccctgcttttgaggcttttggactcagactgagccactactggcttctctcttccccagcttgcagacagcctatggtgggacttcaccttgtaattatctgagccaattctccctaataaactccttctataggtacatagatcctattggtgctgtccctctgagacccctaactaatacaatgcctgtgaaaggaaaggagaggaagatgaagtcaagccatgatgcaggctcaccagagtcccagccaagctgacaaagagttctggaacaaatatggttcatcctggaaccaaactgccaggaatgtataccactgcctctgtgtcagtggatgtgggccttccaggaagggtgtgatgtgggcgaggtagctctctgcagctgaggctgacccagcccagtggagccaacagcttgaagccacctgatggccacatccctctgcagctggacagcagatccttccttgcagggagtttgtgtgtcacctctccatgcctgccacgtgtgctttacagccctctagacagagtcattcaggacctctgaacactcacaaacacttaggcaggggacaacatgttaggggaggtggggtgagtgcttgacaattttttaacaaatgctgtgacctcccagttctcaggccaactgtccatctgagacggctaacctagatctgcccaccaatgctggggccacccaaacagtaggcacttggactatgaatgaaaagtttccatggtcaaaatcacccccaagaaaatgggttccaggaagtgtctaatcatctggaggacatgggaagatctaggggccatttaggagtttcgaccagcaatgatgagccactcccttagggatgtcagtaggcctcccacctctcattccccttctgggctcttcagccaagagcccaaacctgcttctgtccaaggtgctacttaggcagctgagaaccccctttagggcctttttgatacataggaggaaggaaagaagcaaaccatttcctgcagatgccccgagttctccgttgggcagaagaaccatgggccaaacgcctactctttctttcatccattcaatgtttgttgagtgcctgtttgtagtgaaccaagcagatgaagcccctcccctcatgagctttacattccctggaatatatggtgcatcagacacaatgctggagattgcacgtgaagtcaaatggaatgaccccagcctagaaagcaaacaatcttatgagtcaaagctcaaaatgaatctgacttcatagggctcctctcgagcagatcctttcaattcattttccctggactctcgagtctgatgaagtatgagaatctagacgaggccgtggagcctgcctggtggcctgcaagccagcgcatctgtgctgtgccacccacctctgctggtagttagaaggacaaggacagcatgcccctaaagcacctctgagtgtcacctggaggtgttgggcaagaagctcccatgactgtggcagccacagacatgcattcaagcccttctcccgctgcctctagcagtgaggaagggagcaacaccctgggactcaaagcggcagggctttgaggtgtccattggagctggccttggtatcacagtattttcttctcacgtaggctcaggagacattgtccatgacttttgtttcagggaagatctggagaggcaaatggtcatgaaacctctgctgttgcaaaccaagactgcctgcaggagggcggcttgggctttctttctgaggtctggagccagggactgttcccagtggggaagtttgctgcccacaatctctatcctaaacctcatattcccagatcccatccctagcccataagtttctgcctgtcacagcagcaattataaaaagagggatttaataaaaagaatagtggtgtcccagcaggaatttccagtccacggttcagacgaggcggcatgttacataatgaaaagactaaagggccctgggactttctttttgatctccaacttccaagccagatcctggggagcttaaaaactcctctcatcttattttaaatgatctcatttcaggttttgttgtgtttttgttttttgttttttttttccttcttcactttaaattgacttctcctcctagcatttccacggagcatctacctggaaattcgcaggaaaggagtgtcagcctgtcctaaaacatgtttggtactagtggtggggaaagatggggaagaaggtcactagtggggagcccactttccagccccagcagtgggatgggtaagagtcaggctgtctacatccaggttccaacttcattgctttgttagtctacttgggctgccatagcaaagcacagcagagtgggtggcttacacaacagaaatttattttctcacacttctggaggctggaagtctgagatcaaggtgtcaggagggttgctgtcttctggctttgcctcctcaccttgcaggtgccgtcttccccctccccatgtcttcacaggctcttccctctgtgcatgtatcctaatttcctgttcttataaggacaccagtcatatgggattaggacccacccctatgacctcattttaactttaattacttctttaaaggccctagctccaaatacagctgccttctgtgatactagggggtaagacttcaacatatgaatgttgggggagagagaattcagcccgtgacaaccatgtaccaactaggtgaccttaaccaagtgctttttaagcctcttgtgcctctgttaccacatacgaaaaatgggcacagtgatagtgcttcctagtgggattgttgtaaagattaaatgagttaatacctcgtgagttaggtatgatctaaaacagtgttgggaactgttacttcagatgaaagctgagcaaattctcaaggcatagccctttcatgcttatgatccatgggatcgaggcatgcccaactttgtcctcagatccagaaagcttgtgtggccagttatttttactgttggaaagtgctgcgttgttcagattcccacaaaccaaactgtaaaaccacggcagggtgaaccaccagggcagcccagagctccagccagctaccccactttgctccccgagtgccccacatcccaccctgcctgattacagaggcttaaaatgtgacagcaaattattttattctcctccctcccatcaaaaagtggcatctaattacccttctcttgataaggagccagctcagcaattcccttacagcaaatatgagacataagtgaccttgcatggctcccaggctaggtcagaaaaagcattatggctttctccttggtttgctctctctctttttcttgggacattgatctttggagctggtagccaccatgaagcaagcccagctacctgaaggcaccgtgctgaagagaccatacatggagagagatgctcagggagcctcagatgttctctccccaactgtttgaatgtttccagctgggaagccagactcagaatatgtactatgcatatgatttcagcctgcaatcctcaagccaccccaatcgatgccaactagagcagagatgagctttcccgtggatccataggatctgtgatcatgagaatggttgttttatgctaccacatgttggagtaactttttaagcaactgacattactggagcatagatacatagataaaatccagccactctcagacaaggcaatgtgggtgcttctcaaggcccctaaacaaggaagtgcctccagctcctccctttggtgcattgggttgtagatctatgattatgagctctacatccttttttattagtatacgttgtatgtatgttattaaaaactgccagaaggaacttctgtttgttggtgaatgacagctgatagggtcttaaaagaagaccaagtctgattatgagatggccgtgcgggtaaaaagtgatgtgtacagattaaactatggcaagggaaaatcttggctgaggggaaagtttatcaagaaacaggtttgggggatacctatggttttaagatactttattctgcagggaaaaaatctcctatgactcaccaaaagggtcacaagaccacccaccttggcccaccaaccctcttttgcattttcagaggaactggaccacttttttccttggctgactcactccacagtctccagtgttaatttagacatcccatcagtctatctagcctgagggtctcccagcacaaagaggctatcatcctgcaaatccacccatgacacctttactagttaggcagatctttttatcagggcagcttccagcatgttagaaataagattaaacgattactctttttcctttggaataaaagaaatgatgattggggagtcttaagtgtctgtgtgttgtcaatcttttttgggggggaaagcttgaagagataacgattgtattcaagcatctcaaattcaaggctctttcaaaaccagtatattctgcagtgctctgcaaggagaaacattacagagggtgagagattaggcgttattaagagaaagaagctgaaagaggaagaaatgaccttgccagaccctcagcagtttgacattaaagcttggcaacaaagcagaagttcaccagggagcaaacagctggaatattcacaccagttgtcctagctgtcactgggacactagcacattcttggggaaatccagataaggccccacctgctgggacattagcaggtcttctgtcttgtgtttacagagcagctggatgattaacgcatgtgttgcttacctgagaaatggaatttgagcttctgtcctgggagagagatgagaaaggagagaatatctgtggggctggatgaggcaataactctggcctcatttgcagtctgccttgcaaagacagagagggagagaatgatggggttcaccagctctcattgcatttaccagaaaaaaatgtttgcaaagcccagacatttttcaagggacctgagttttctgcagaatgaaaatattactaactctgaaaaggcttcttactagaaaagtaaaactctccaagctgccagattctttttggaatgagtttgatgtgaaaggtgccttaagatcatctattttctctttagtggccatggagagttcattttctagactctgcgcccacaccatttgcaggtaacaaaaggaggcaaatagcataatttccagcaaacacaaaagtaaaacactgaacttcctgttcttaagaattcttcctgattaacatctccccatctgtgccttcctctttgtgcagcagtcatgcaggatgcttgagtggatctccagagactgacattatcaaaccaatgactcaaagcaggctcatttctccctatgtctcttagctccttgatggttaccctgactcatcccctcaacagtaaccccttagcccttagacctaacttcctcagaagtagatttgtagaagggttgttggttggtttgtttagttgtttttaactaaagatacttaatactgttcccctaggaaccctcttgaccctcttggttagagtgtgttggttctcatcccctcgggaatttccaaatgcattcagtagatgttccttttttgtagaattcatgtcccttaggtatgtccctggtatctttttacttctagaccaatgtctctcccattttatcatgcacatggatcactggggatcgggttaaaatgcagattctaatttgaaaggactgggatggggcctgagattctgcatggttccaggtatggcagctcctgggttctgctgctgctgctgtacccagaaccacatgaaagaacaacctgttggacgtatccagtcttctgctctttccgtcttccctggaacccctggctccaccatttctccttagaaatgctcctcttagctgttatgtttgtgaaagatcattactaggaggcattaaagcccagaaatgccaaatctcctggttgccaatgcagatctgtcatgctcatcagcccctgcccaccccactttaaatatggattgagctcctcccctgtgccaacatcaggcaagatgcagggaggtgatgggttctgaggagctctccttagggagtttttgtgcacttgcagagtcagggacccagaaagaaaaccagatgagagagcaagaagtaaaggacttcagtgcatgattgcactaaaccagtgccacgaaccttcaggaacttgaaaggagactggggatggaacaatcagaggcttggtgcagaaaaagaaactggagctgggttctaagatgtatggagaaggaagcaatgtggagaccagagtgaactcaggctcactggaggaatgagcatggggctgttaagggctaacctgtggagagctcaaagtctatggagaaggagaaaaccaagatattatggctgggtcatttctagagtatcctttagtgagctggtaaaagtgtttagtgatagttctctgcttgtcatcaaactagtgctataattcacaccctttgaggttgagtttctgatcagaaagagctgaaaaaggaaaaatatatttcagggagcatggttcaacacattttcactctcattcttggagtctgtgtcgacttttgagaaggtcattcacaacacaccatgctttgggctaaactggggaatagagtatctgaaaataaacttaacattccaaccatgctaaattattttccaaccctggagcatacaggtgagttcagatgagttcagttgtgtattagcccatttgtgttgctataaaagaaatacctgaggctgggtaatttacaaagaaagtaagtttatttggctgtcagttctgcaggctatacaagaagcatggcaccagcatctgcttgtggtgagggcttcaaggaacttccactcatggaggaaggagaaggaggagcaggcatatcccatgtcaagagagggagcaagagagaaggaaggaagatgccaggctctttaaacagtcagctctcgtgtgaactaataaagtgagactcactcattattgggggtggcaccaagccatctgcccctatgacccaaacacctcccacttggtcccacctccaacactggagatcaaatttcaacatgagatttagaggagacaaatatccaaaccataacaagttctaactgttttttgttttttgcttggttttattttttaaacaaaaaaagctatcaaatacagtgacttgaattcagagtctttaattgaacaagtggctcccatgggctctggacattgaaaaagccagcactgcaggcccatgtgtctattgcctatttatcaagatggcggcaagtctaatgccataaatgctttctcaaaatgaatggctcttggcagttgagaattttgtgtgctcaccaccagcagcaagcatgctcagctctgaaacaggagctgcaaaggaccatcaaggctgtggctagtttgcaaaggcttacctttccagtagctttagatttttatattagtaatgtctattagaggttcagaatgtattggggttggccagcacaatgccatctagaattctgctgtccagaatggtaaccactagccacatatggccacccaaacttaaattaattattttttaattaaaaattaatttcctcagtcacaccagttatatttcaagtgctcaataaccatatgtgtttagtggctaccatattggacagcacaagttatagactattttcacatcacagaaagttctattgagcagctgctctagaaactaatcacatacattgtcttaatatccagtggtgggtggagaatgggcctgccagggtatgagcgaaacatctgtggatgaagagcaaatatgtgtccctaggaagaaagaccacaccagtatgataccaggtggactaagctacataccaacagcacaaacacttggtggccagccacatccctgagactcaggaagaagagggggaattgaagagcatgctttcttctccacaaaagcctccttttcctgaactggcctgacaactccttctcttatcacaagccaaggcacacccctttctcaaaagagccaaggcctccagaaatcttttcagatctcacctcctattactatactttgcttcaagaacttacttgctttgtctgggtacttctaagctattgttttcaagtattttacctgtcacctgcgtttcttctcagtcccttctctctgatgttttgattggactccctgcttggtttgatcttgccttggcctctaaaggtcatttttccaaagtcactcagtgacagctctgtaggcaagtatcctggaacccagcattctagaactcaggcctagaatagttcctgagatgcccacttatctgggaaggaaatgcacacatagtggcagtatcaaaataaagttgtatgtatgagacagctattgctgtgtaacaaaaagcacctgaatctcagttgcacacaagaacgaacatttatttctcacatgtctttcattctggggcccaggacaaaatagcagcggctactcagggggaagtcttctcatggtgatggcaaaaatacaaaaggaaaagtgaactatgccaggcctcctaattttaggctcagagctggcaaaccatcacttccactctccttcagtgtccaaagtaagtcacatcagcatgctcaaaatcaaggggctgggaatcacattctatactttacaggaaaaattatatagttactgaaatagggtgtgagttcacactgtgcatgaccacttatttagatcttgggaagaggaagtgagcaggcagtcagtcatacagctcccactcattgagttctgattttgtggatgagtctacatattatcatttatctattgctatgtcacaaactattccaagatttattgacttaaaacaacaaattttatatagctcataatttttcgggtcagcaatttgagctcaacccaatggaatggttcttatgatctgggctgatcctggctgggtttgtttaaatgtttcaggctgggaaggctgcacctcacattctccagcaggctatcccaggcttgttcacacagtgtagtggagaagttcttgtcataagagtggatgctcaagcccttttaaaacctaggcttggaactgaagccccattacttctattgcatcctatgaattaaagcaagataacagattcaaaagaggaattggggaatagactccacctcttgatggaatgatgatcaaagaatctcagattcttgttttgcaatctactagatgaatcaaggatatatattccattactggaaataacattataaggcttggtccccatccaaaatttaccatatagaggcaacttgagtgacacatattaagtgcagatagagtttggaagatgtatttccttcctcagttactccctatacagtgggacatctttgcttgccctgtcttgatgagacaatgtcaaaagtatgttgaagttatataatatactatgatggcagccagttattgccaactcaatatcataccagcaattcactgggaaaattcactgggtctgaatttactaagaaaatccccatgtatgtccatcgtcagtattaccacctgtcagttcttttctaagggatggagttgcagctgctaataacagctgtcaataacagctgcaatcataaccctaaatccaagtttctatagtttcattctttctgggagccaaaatgactgcaaacatatattttgtcatttattcctactgaggtatgtttattcagaaacagttgggcacaagtgaatgcaagtaataactccctaaatatatatatatctttccctgaagtcccagtttcccatttcatcccatcaagagtgttaatgcaacactttctcttacttcaggcattgtaaatctattcatctgattcacgtttcttttggattgttcctttctccacctttattgaattctatttttcttcctatttatctaggggcatagtttattcatttttcctgagtttagcccacctgactatggctttatagcctgtttgtgaattggttttagtaataattattatattttaatattacttggattcataaaacattaattttcaacttacagtagtcactaagtccaatcaaaatccatcagaattcagatagaaaggaaaccacattccaagctctatagtaagacttgacatgatcctgctcatctttatgtcagtccagaaagaaatgcattattacttccatgtttcagctgagaaatctgaggctcagatcagggaagtaccttttctatgttccaggataggcatgaagcagaccaagaatattcttatcatttttcctgatgatgaaactgtgatgtaagttacatatagagaaagaaattccaatatttttctaaaagacacttatttttgtacattgttattgaaggtgacagaaaagggtgttgagttgaacagaataaaatccacctttagagtaactatgcaacttatttcaagagtaggtgaatatttcttggtcctattctcctgggttctaagtagttcttcccaggaaaacataagagagattacgtttaagtagttagtgcttccttgtaaatgtatagtccttaatgctggtgctctgtttctaccacagcctgaaaaatataaaataactctagtggctttgctccatctcataagcatccttatcaccaagtaccaggagtaagaatgagcagtgtagatgtggaggaaaaacatttgttttcatgatcttagtcccccagttctactgaaaaggccttgggtattttgattactgacaatatacctatttgatcattcctcatcccttgcaaaatgaatatgggctgtcacgtagagccagttgaatactgtgaaaagatcacagtggaaagtcttaagggcgaccttggacaagaacctggattcctgcttctaactgaaaacatcctacaaggttatacaaactggtaggaaatggctgacctactggagatctgcagattgatcaggagcgaagccacttagagcgtatcagattctcttgttatctgcaaagcaggagtgagtcatttcattgagctgttggcatgcaacaggcacttaggaaagatctgacgaagtgaaagtatccatttgggacccattctattcaaatatgtgcctaccctcaagatgcatgtatctgtctgtgttgtttcttagaagtggtacaaccgcacataagccattcttcccaaccactatcttcttcattttaacatgtaaaaatattgttattccattatgtctaaattcttcattttcttgactctcctactatctccatagtatttccacatgtaagatgtaggcttttgtgagaaaaagagaattcctttaatttgtttcagcactcattaacctaacgtgattcttgaccattctacatggaagtctacttacactttccatggacacaaaggaaccttgattcttatatttacttggcagatggactgaggatggggggaaaaaaaggcacagaatgaaaacaagtaaatattctggggttcagggagattatgataaaataaataaaggaacaacaagctgtaagaagaaaagaaaagaataagtcatgcctgatcaacattattttaattgttccactacattaattaatggaaggaggaacaccatggtgcccacccttgagaagaatgttctgttgagtgatttgtgaaacatttaactatcacattcattgaacaagtataaacacagagtagtaataagtgacaaggattctataaggagatgtatattagcacaggtaggagcaaatttgaagtaatttcgaggaaaatgtaaatcagtcactgagaagaaaataccctcagctgggagttgtggctcactcctgtaatcccagaactttgggaggctgaggcgggcagaccacgaggacaagagattgagaccctcttggccaacatggtgaaaccctgtctctgctaaaaataatttttaaaaaaaattagccaggcatggtggggcacgcctatagtcccagctactcgggagactgaggcaggagaatcgcttgaacccaggaggcggaggttgcagtgagctgagattgcgccactgcactccagcctggcgacacagcgagactccatctcaaaaaaaaaaaaaaaaaaaagaaaaagaaaaaagaaaagaaaataatctcagcctgcagaagtgagagcactcatatcactgatgagtagagagagcatcagtgatttcagcaagatggtggaacaggaagccccaggtccttcccccatggagacattaacttaacaacaatgtataaaccacattgcctttgtgagaacatcagaaaccagttgacaggttacaggaccccaggtgagtacaacaccaagaagagacacattggaggagggaagaacatttgttggacttacctactatatcccatcctccaaactcatggcttctccttcaggaggaaaagaaaaaggcagaacatgcacccaatgcctggattttgggggtgcttctcaggggactggttgctttcttgcctgacctagaatgctggtggggaaacagcacacttttgatacctgggggccactgagaaccaaggcaacagttctgcttgctacaccactaccagagaaattaaagcatcacagacagacaccagggggagctactgagtagaaacaggcacaccacttcagctgggaaattatacctgtaggcccagagatgatgcaaccgctgggaagatttgagaggcctgcagaatctctagtggggctaattggagaagatgttccctgtctgaagacagtccatagagactgggagaggtgtttgttttttcaaatgtccacatatcaacaaaatatcgtaagacatacaaaacaacaacaacaaacaaacaaacaagaaacaggaaaacatggcccaataaaaggaaaaaataaattaataaatctccagtaactgacccaaaagaaataaagatttatgaattacctgaaaaagaattaagaataaccatcataaaaatgcccaatgagctataaaacacacacacacacacagacaactaaatgaaatcaggaaaacaatatacaaacaaaatgagagcatcagcaaaaagaaactataaaaaagaactaaacagaaaatctagggctaaagaacaataactgaattgaaaaattcaccagaagggatcaacagtatactgtatcaagcaaaagaaagaatcagcaaacttcaagacaggttatttgaaattatcaagtcataggggtaaaaaacaaaaaggatgaagaaaagcaaagagctattaagagacatataggatacgatcaagtggaccaatgtacacatcatgggagttcagaaggagaagaaagaaaggacagagagcctatttgaagaaataatagccaatatctccgcaaatttgaggaaggaaatgggcatacaaattcaaggacctcatataactccaaatacaattaatccaaagagaccttgccatcaaacacactatcatcaaactgtcaaaagtaaagacatgaatcttgaaagcagcaagagaaaagtgatttgcctcatacaagagaaaatccataagattatcaatggatttctcagaagaagccttgcgggccagaatggattgggatgatatattcaaagtgctaaaagaaaaaactgacggccaagaatactgtgcagaaaaactgccattcattaatcatggggaaattaagattttctcagataaataaaagctgagagagttatcaccactaggcctgccctacaagaaatactgaagagagaccttcaagttgaaacaaaaggattctagaaagccaaacaaaagtatacaaaaatatgaagctctctggtaaaggtaaatacatacacaagtatagagtcccatggtattgtgatgttagtgcaaaatcacttaattctggtatagaatttaaaagacataggtataagcaataactataaattattggtgagtaaagagaaatcatcttagaggcttagggcacaagagatcctatgaaaagccactatggctattctcataagagattccattttgagcaaagttgcccagatggagatgagggagattgtcaaagtttaaaacattatacaacgttggaaaataagattaagacagctagtaactttgaagatatctgtttaataatcacattaataacagtaagtttggagacaacaagccacccaaattctcatgagatccatctatgtttgacttaaatgatcaaaatgacttgagatatatgaaattaatttgccaagtctatttctgtaatcttcaggtcatctgctacttacactgaccaggtaactctagctttgttttgaaagaaggtctgatggtgaaattaaataacaagttaggatcaaggagaccatttgagagagaaaaggatctaaattctagttctagaatggaatcccagacataacatataactgaccccaattattctttagctaaaaggtatccttttctacaacaggattgcagtcattcttttccaattgactcagcaatatataacctcattttattatttaactttattttcatagctctgacataagctaaactccatttaatccaaaaggatttttaaagtgtctatactggaaaagactacaatggaaaaggactgactttgtacctagagcaggccaggatgaaaacataccctaggaccagaacagcaaggagggatgggtttcaatggatggtgctctgaaaacagcctcttgaaatttagatgctggcccttgaactaattgtatgggtggagcacgttagctgcttcagaataaaaaccaattatattaacaaccaccctcattatgcaggacataatcaccatgaccatgtcaatatgtgtgtggaatatggattttaagtattttattatgaaagtattgtgtgttgggcacagtggctcatgcctgtaattgtagcactttgggaggctgaggtggacagatcacttgagcccaggagttcgagaccagcctgggcaacatggtgaaacactgtctacaaaaaagaaaaagaaaaaaagaaatacacaaattagcgtaggctggtagtaccacatgtagacccagctacttgggagactgaggttaagccttggagatggaggttgcagtaagctgagatcacaccgctgtgctccagcctgggtgacagagtcagaccctgtctcaaaaatgaaaataaaaagatattgtgaatattttgcgaagtgttgtaaggacatatccatcaaagaatgtctaaaataaagccaaaatacatcaacttttatttttttttaagtataggtgctccttgacttatcatgagattacattccaataaacctattgtaagttgaagatattataagttaaaaatgcattttctacatctaccctatcagttgtttacactcatggtcacgtggctgactgggagttgtggctcactgccaccgcccagcatcacgagggcattgtactgcacgttgctagcccaggaaaagatcgaaattcaaattttgaagtgtgcttcctactgaatgcttatcactttctctccctagtaaggtaaaaaaatcttaaaccatcataagttggggactatctctgtatctgtgtgtatgagtgagagtgtgtgtgtgtgtgtgtgtgtgtgtgtgtgtatgtaaccacaattttttaaaagtttttctaaaatgtggacttcagactctgggaaatgtgagtctggctctgactccgctgttctcaactgtgggaccttgggtaagtctttctgttgtcctaagcctctgtttccttctctagagaatggcagtaaccacacacacctacacaggattgttggaagagttagatttgtcaggctcattaaagacactcactccccatgcacagcctcaagtgcagggttttggcgcaccagctggcctaaggaaagcaaacctttcttctctcaggaaaagaattggaacccctcctttagaacactaactgtgcatggagtagctggagtcggcagcacctggtgcctggcatgcgaagttccatagcagggtaggtgtattagcttcctatcacctctatcacaaattaccatgaacttagtggcttaaaacaacccaaattgactctcttacagttctggatgttagaagtctaaaatcgaggtgtcggtaggaatgtattccttctggaagcttttggagagaatccatttctttgcttttctcagcttctagcggccacctaccttccttgactcgtggcctcttccttgtatcactccaccctcttgtttccatcatcacctctctcactcatccctctgatcctccttcttccctcttgtaaaggacccttgtgattacataaagttcacccagataatccaggctaacctctctatcccaacatccttacttacttctgcaaagtctcacttacaatgtaagctaacatatcatcagattccagggattaggatattcaactagtcataccaggcactgtgtttttataggagaccatcaaacagattgtatacaccaccactgagctcagcacaagggaaaaagaacaactctgctgcagaataggtgtccctgacaacagctctggcatgctgaaaggctctaggcaccccgtcctagaaagtctattaaacaatgccaggcctggtcctccaactcttagggctgtttgaattcaagaactggaccatgtagactttgcctcctatgcagaaatttgccttcacagcgagttgtaagctcctacaagatacggacaactttccattttatttttactacttgagaaaaatagtttttttaataaaatgcatgtaagcatggacttttgagtcattcagctggctccattgctgggcatgtgcagatttatcagtttaccatgatctttggctttccacatctgtaaaatggagacaactttatgtagcatattcttagtcagccagggctgacataataaaataccacaaactgggtggtttaaataatgaaaatttattttttcacatttctaaaagctagaagttcaagctcaatgtattggcagagtttacttcttccgaagccttcctccttgcattgtagatggctgtcttctccctgtgtcttcacatgatcttcaccttgtacatatctgtgtccaaattcattcttataagaatgccagtcgtggccgggcgcggtggctcacgcctgtaatcccagcactttgggaggccgaggcgggcggatcacgaggtcaggagatcgagaccatcccggctaaaccggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaatgccagtagtattggattagggtccacctaatgacctcactttaagttagttccctctttaaagactctatctccaaatacagtcacattctgaggtactgaggtttaggaccacaacttatgaattgggctgggggaaaggcacaattccccccataacaagcacccttcttaaggagttgtgtgagaattacattaattaaagcatgcagaggaaagtccctagaatgatgcctggcaatcataaatattcaataaaatgctgctgctgttactgtttgtaaaggaagttgtccaacactccctcccacctctttctatatctgccataaaatagttcacatgtttataagaaaaaaaattcttgtgccttccatttcttttcaagttccctactcagcatttatttttataggcatggccattcctaaatactgagacatcgccagtcaaaggggaagcattttcagcttgtgctccatggtagtggtgtttatgtgctatttaaagggaagctgcctatctctttgaaatgcttattatcaaagcatgcctgagtcaacttttccagtgcagtaatgctggctttgattttcacagaccacttttgatatgattagctcgttctctcccactcctgggagccagcatcttctcatttacagatgctagttgcccagcggccaccagaaattctgctggggagactctagttcatttaaggaggaaacaaagggctttaaaatatatagatccaaagcactcctacagtgttcatcaaaaggcttgtcccaaaatgttcatatcagttttaataataataatacctcaaaaccagtaacattccaaatatctatcaatagggaaatcaatgaacaaatctaatagtgctcaacaataaaaaagagaaaattattgatacacataacttaaatgaagctcaaaaatatgctgagtgaaagaagcaagcacaaaagtatacagtatgattccacttatatgaagttctagaacagtgaaaactaatctacagtgagagaaatccaatctgtggttagctgggtggggatagatgaggtgattgactggaagccgggggggacacttttctgtgtggtagaaatgctctatgtcttgactgaggtgatggttgcaggggtatacaacatcttatatgaataaatttcactgcttataaatgataccgcaaaaattttatttaaaaaccaatcaacaaataaaacaccatccaaccaagatagaagaaatttaattatcttcacagtgcgtatgtttaggaaaaagatatttgactacatttttcatatttgtgcatgctatgtcatagacacagcctatttctaactcactgatggctgtaaaatgtacccaacttgagtagaggatctatctctttctgtgaagaatctcactgctggttctcagaacagacacttacctcccctgactacaagctcgttgaaataacagcctgatacacaaaggggagggatgagtccatcattgcccagataccaataatgcatagcgagagtagtctagagtttttaatgaatttctagagaacagaaataagatgtggttgtattgatccagagtatggaaatccttaaactaaaacacacacaggaaaaagctgaagtggggatgagggacatgaatcctagagggtctctctgagcttaaagcacagaatcagaaaatttggtgtgtgagtaggttgatgaagaaggagtaatcagggtaattaattaaacaaatctttgtgcatcaggtatctattgctgtgtaactagcaaccccaaacttagttatgtaaaacaaccaccacataattcttctcagtgattctgtgggccaagaatttggacaaatcacagcagggatggcttgtgtctgttccactggaaatactggaatagctggaggtgacgtgaatgactggggctggaatcatctggaagattcttcactcacatgtttggcacctggattggggtgactcgaagactgggctcatctaggactatcacctggagcacctttgtatgttcactctatgtggcttgggcctccttacatcatggcagcctcaggttatcagattactttcatggcagcttagggctctgagagtaaatgttccagaaaataagaaagatcaggccaggcgcggtggcttacacctgtaatcccagcactttgggaggccgagatgggtggatcacaaggtcaggagatcgagaccatcctggctaacacggtgaaaccccgtctctgctaaaaatacaaaaaattagccaggcgtggtggcgggcgcctgtggtcccagctacttgggaggctgaggcaggagaatggcatgaacccgggaggcagagcttgcaatgagccaagatcgtgccactgcacttcagcctgggcgacagagcgagactccatctcaaaaaaagaaagaaagaaagaaagaaagatctcccaaggccttttatggtctcacctcaagagtgatgtaacaccatttctgtcatgctctactggtcaaaaagtcacaagtccacctttattcaagaggaggatatataggtccccaactcttgacgagaggagtgtcaaagaatgtgtgccatatttgaaaacatccatccatcgaataaatggatcagttggtccttgctcatcactattaatagactaatggctttcccaagacagtaccagaaagatgctctttaaggcaaaagaaggtatgtctagggaggtttgtaactgagagagaaaaaagggatgtctttcaactttcacaaggttcaatattgcagaggtctaaccaggagccaagcacacttaagtattacattctctcttttattttggcttttgagcctaccacactgaccacacaccctacagtgaagcttgccagtctacacatcctatttacctccacagagccagcaatcagccttcctgtttggaggaatttgggcaaatagacctatacacctgcaaagaacactcacactagctgccacatcactcatcctggccactaatccatatgtataaggctgcttcctcaggctaccaggcatctaaggatccttcccaaaggaaggaccaaaatgggtaaacagagcagctgtctaccaagtaaccgaagataattccagtaatagaaatcaacttcttaaaagttttaattagtattctcagagagcttcacagggatattgaagccataaaacaagaacaagccgctatttaaaaaagaagaagaagaagacggcagtaggagtaagcagtaaaaaagaaattgttggcctggcaccgtggctcacacctgtaaaatcccagcactttgggaagccaaggtggtggatcacctgaggtcaggaattcaagatccgcctggccaacatggcaaaaccccgtctctactaaaaaaatacaaaaattagccagacatggcggtgcatgcctgtaatcccagctttttgggaggctgaggcaggtgaatcgcttgaacccaggaggtgaaggttgcagtgagccaagatcgtgccactgcactccagcctgggcaacagagcaagactctgtctcaaaacacaaaaaattgttcttaaaatttttaagtgtggcttccaaaatgtaaaatataatgaaaaggaccaaaatagtggaattgatatggtgatgaccaaaatagagacttgagagacatacggaatatttttttaaagatgatgtttcagataacaggttctgttttatcttaacataagaacataatcttttgaatagggagtaggccagcacattgaatccatacaaaaatattatgttcctagcacactatttggctccacagtgagcaatattcgcgtactggtagtaataatataactgctatttatcgtttaatccacatttaaaggaatccttagataaggcatagacaactgaaagaggatgacggattagaatgtaaatgttttcagtgttgacaatataagaatcaagttatatctaagaaaagattaaaagtggaagatggagtgaggaggtggctggaagataagaatgtgaacatttttgttctacctaatatggaatcgagagatactcccgaaagctaatggtatgtgacacagaggggaaagcttcaaagatagtagtcctaataattataactatcaaatagattaggagtataagagaatgcaggacataatataaattagctaaaccttcatttttcttttttttaaattttatttacatgtgcagaacgtgcaggtttgttacataggtaaagtgtgctgtggtggtttcctgcatctatagacccatcctctaagttccttccccctcatcccccacccctctacagaccccagtatatgatgttcccctccctgtgtccatgtgttctcactgttcaactcccacttaggactgagaacatgcagtgtttggttttctgttcctgtgttagttagctgaggatgatggctcatttttcatagtgggattcaatagatgataccaaaagtagataaatctagaaaggcctattatgattcttttatttggcattatataaataagaactaaaagactccaaaatgaaaataaataaaagtgtataccgctgggacataggagggatgagacagggaagagttgtttttcattatcaacccttaagtattatttaatttcataatatgtgcaatttaattttattgaatatgggaataaagtccttaagatacccacttgaggaactcattttcaaatacccaagaaaggaggagtggagtgagggagaggagaagcaatgagagtagctgtcacttatcatacagactttattacatgccaggcagtgttctaaacctgttacatatgtcaatgcatttgatcctcataaagaccttgagagggtgctattattatccctatttttgaagatgaggaaactgaggcacagagacataattaatagcttgctcaaggccagacaagtagtagtgtgtccagaattggtgggttcttgctctcaatgacttcaagaatgaagccacagaccctcgcggtgagtgttacagctcttaagttggcacgtctggagttgttcgttcctcccagtgggctcgtgggcttgctggtttcaggagtgaagctgcagaccttcgcagtgagtattacagctcataaaagcagtgtggacccaaagagtgagcagtagcaagactcattgcaaagagtgaaagaacaaaccttccacactgtggaaggggaccccagtgggttgccactgctggctccggcagcctgcttttattctcttatctggccccacccacatcctgctgattggtagagcccagtgatctgttttgacagggcgctgattggtgcatttacaatccctgagctagacacaaaggttctccacctccccactagattacctagatacagagtgtccacacaaaggttctccaaggccccaccagagtagctagatacagagtgtcaattggtgcattcacaaaccctgagctagacacagggtgctgattggtgtatttacaaaccttgagctagatacagagtgctgattggtgtatttacaatccctgagctagacataaaggttctccaaggccccacaagagtagctagatacagagtgtcgattggtgcattcacaaaccctgagctagacacagggtgctgattggtgtatttacaaaccttgagctagatacagagtgcccattggtgtatttacaatccctgggctagacataaaggttctccacgtccccaccagactcaggagcccagctggcttcacccagtggatcccgcactggggctgcaggtggaggtgcctgccagtccggcgcgctgtgcagccgcactcctcagcccttgggtggtcgatgggactgggtgccgaggagcagggggcggcgctcaatggggaggctccggccgcacaggagcccatggagtgggtgggaggctcaggcatggcgggctgcaggtcccaagccctgccccgcgggaaggcagctaaggccaggtgagaaatagacagcagcgccggtgggctggcactgctgggggacccattacaccctccgcagccgctggcccaggtgctaagcccctcattacctgggccggcagggccggctggccggctgctccgagtgcgggggctgccaagaccacgcccacccggaactccagctggcccgcaagcgcggagcgcagccctgattcccgctggcgcctctccctccacacctccctgcaagctgagggagcctgctggggccttgatcagcccagaaaggggctcccacagtgcagaggtgggctgaagggctcctcaagtgcctccaaagtgggagcccaggcagaggaggcgcggagagcgagcgagggctgtgaggactgccagcacgctgtcacctctcagtagcggtaatgcaggcacaagtgtgtcatttttttatctttcctaacaagacatcaatacaaaacaagatacagaagtggaagcaaattattaagggttagtttactgacacctgaaataaggaaaaggagaaattttaagaatgctgacccctggtgaggaaggctggggtgaggcaaggaggggccagagatttttttacttttattttatactcagttgtcctgcttgattttttttaactgtaattgtcaatatcattttttaagcaaaaatattttttgtcacacctgtaatcctagcactttgggaggccaaggagggcagatcagttgaggtcaggagttcaagaccagcctgcccaacatggtggaaccccttttctactgaaaatacaaaaattagccagatgtggtggcggatgcctgtaatcccagctactccgaagtgtgaggcaggagaatcacttcaacccgggaggcgaaggttgcagtgagccgagatcatgccactacactccagcctaagtgacacagcgagaatctgtttcagaaattatatatgtatttttatttttatgtcatacaaaacctacaattatcactgaacttttaagttaaaatcagatagaaataggaagaaattgataaaaacttaatttatgacccttttgtctcctaagattggagatacaatttgtatgtttgcatgacttttgcaaccaaatgcacccttaggaaatttgacttaaatattttattatgtcaggtgtttgcttcatttgaaggaaaacatatttaaattttcttgccagtacttctattcagtttttaaagtgcagtaattagattttaccagtcttgtgcataagatacaaagtgagactatctgacttttagtgccacaccataaaagactatatggcttctgcctgttctcttgggacacttgcatttggagcctgagcccccatttaagttgtctgattaccctgaggctgccctactaaggaagccctggcctcaagttcagcccatatacccatctgagatctctgtccacagtcagtgtcagccacccatcattctggcaaaaaaaaccttcagatgatttcagccccaagcctctgagtcttcccagctataaaattaaacccagcaattccacacatcttgttttatgctgatgggactctcaaagtaaatttttattataaatataaaagggatattaaaacagatctgctgtataagcagagatggatagcagcgctgctggtgtgtggactctgagataatcctgaagcatgtacaaaatgcgctgtgacttctcgaaatctcatccacacggatggggctttcttcactgttgtgtgggactggggagtgctagggtatttctcattttttattgtctcacatctattagcctcatggggtgcagcaggagggagcagtggtctcagtccctatctcatgttagaattactggggggtatttttaaaaccccagtggctgggccacagcacagctcagctaaatcagaatctctaggggtgggacccaggcatgagtatttcataaagcttctaggtgattccaatgtacagccaaagttgaaaaccagggcctccctgaaagagtttgattcagaaggtctggggtaggtgggcccgggaatctgtacttaacaaagacacccaggtcattcttacaatgatgtaagttagggtcttacctcaacaagggactaaccatgtgcactctgcagtaagtcagacctggctcaaaacgtagtcctatcactttcaaactatgatcctcactaagccttagttttctcatctgtgaaatgggaatattaaaagtttgtaagaaaaaaaaggcatgtaaagtgctgagcacagtgtttgacacttaagaaccaattgttaaatgttggctcttgcagggagaggcttcagcacaggccatgacctcctggaaaacaagaggttcctgacagccccatatcattcagaggggtctgttcttccctaggaatgagataagattctatagctatttgcaaatgttcactgttccttatgtatatatgcacacagtaatcttttcattccgaaatcttaggatcttctcatacgtttttgcacggattcttacacattgctgagcatctgttatggataaatattatcattccaggtggaaaactgaaatgaggaagtgcataggcagcactcttgatcacacagtacctgaagggtgaaggtgaagagtagctcaggcttccaggccccacacacaccctaaaatgtggaggaaaatgaaggaggtgaggctgcacatggaacccattctcccttgtctcagccttctctgcacaatataagcacatatttttatcactgtacttcctaggctgcaaattgattacctttctgatcctgtgaacagctaaggtgctaactacactctgctgagatggtcttcatttgcaagctgaaaatccacataaatactttgataacataacctccccctatgtttttgactaaaaaatattcagctccttaaggaagggttctttgttggctggttgacttattggctgccttagtcacccaattctctcagctctcttctttattgtccaacacagatcaaacctagatgtgttattgatgtggtactttgttttaattctcaatttctttaatgcaggggggaaatatcttccaagcacacattaaagaaatgtccttgtgttcgatttgccctggctgcagaattgattcatgagtgtcacctgctttccctaccctgagtcacagaaattacttaaaatagatcgtctgaagatcagttggggccagatcagccacacagtcatagcaatcagtatccttgagtataaaaatatcactgttcactcctaagagaagacggtggccggcatctgcacctgagggggacaggtgcttctcttccaacctagagtgcacaccaaatatgcagaagggttttatttggggggttgggaggagtcacccacatttttaaacgcatgctccattttaagccagattagctcctgatactgtgaaagtccccttcattgccaaacaccaggtagaaatcttaattttaaaagcacaatcaactattcttcttcgttgttaattgatgaaaccagaaaaccttggatccttcccgatatgaaccagaaatttccaaatccatgtccaagcctgcgaattgaaaaacagctggctcttctgtctttctatcctctttgttttagcattttaatttttagagagatgagagaaatggagcatctgtcccctgtgattctattactggctctcctaacaccatgaaaaatatcagcttctgcattctgataatattatagacatcaaatgccagtgtaataatgtatgtaattttaggcagggtcttacttccaaagcttaaactcagatgcatagtcttaactgtctgatttctgaactcacctggtaggtattcacttccatttttgtcagcacttcaaatgtaatgttgagtgaactccacactattttggagaccaagtactatgatggtatattcaggtcaggacaccaaaagtgttcctcaagttagagattgctcttaggttttgtaattcataaaacaaggaaatatttgctccctacatagctctagctactaatgtgacaggtatacattttaaaataaattcagctccactctggtttggacttctttataccgtggaaggaataggagagcttggggggagcaggaattttctaacatggttctatccattatacaaaagggtgatttcccccagcatcttaaacagggttgctgctcaaaatagatgaagtatgaagccccaaacaagtggtgcttctaacttgcagcttcagcccacgcacagagtcactaggtgtcccaaaggtcccagatgactctctgtgcctgctgcatcgcgtccagatcccacttctcacggggagggccgtggacctcctccccagcctctcactctttgcatttccagtttcatgggtgtgactcagaccctgaattctctgtcctctaagccagcaggactcacactacaataaacccttgagtcacctgggcacctcggcagcatacaggttctgatgcagcaggtctggagggaggtctgagagttgcttttctaaccagctccccggcgatgctgataccactgtccccgtgtctttggggataaacagcaggaggcacacacttagctgtggggagattgtctgttcagtcctcacagaaatgactccagttctgcactcatcagtctgagatgacagaatgaatattgtgagccactttaattcttcctgcaaaactgtaaatatagccaaatttctctctatgataatgaattaaacaaatagcactcttaatcaaaatctacagataaccccaaacagtgtttttgccattagtttaacctcctccacctgaattcttatcaatatagccagaatgggctgagagcccatttcctcctgcccccttctccaggggaaaattagatgaccaaatgccaagaactgaaaaggagtagaacctcagggcttccaactctgaaaactagattagggagtgggtgagcataaatgagaaaaaaaaatacatctttattttcactaagcacttttatctagcatttggtcttattatacatgaagcaacaaccatagccacatgagctgtatctgtgatgtcgtctccgatagaaatgtgagcaattgcgtgctggattacagtcaccgcagttatctcagagctcttctcattcatcactacttcagagtgaatggctaactcttcttataataaagaaatttactggctcttgttaataaggaaacacatatattaatgaatctctatttttcaatgttttgatgactagatttcaataaatcagtttcctagtgattctattatttattgtatgccttttaacacactattctgcaaagggatccacagagtgtcaggggcgcatagcacagaaaatgtttaagaaccccagagcatcatgtcaaatgttgaagagatggcaactgattgtgttcagcattgttgatgctaattaatataattattttagatcagggatcacagatgcatattcctgcaaggctcagctatatagaataaataagtggagtggttgggtctaaggacaatcctagcagaaagagagtagtatatggcatctgactcttggccttaggagttgggggcaatgaagaggtgggcgatccatgcaagcagatgaatgcacatcccatctatacagggcaccgctgagcggctccacagtgacacaagttgcctggtcttcagatttttccaagagaaaccaaaagtcttgatgttgtggacatcccccctaaaaaaaaatgcaatgtacactttagcaactatttcaactaacaagaaacaaagaaaaaattctaatcaggccaaacaaccaaaataaaacaggggctcaggccgagcacagtggctcacccccgtaatcccagcactgtgagaggccaaagcagatggattgcttgagcccaggagttccagatcagcctgggcaacatgcaaaaactccatctctactaaaaatacaaaaaatcagcccagcgtggtggcatgtgcctataatctcagctacctgggagactgagatgggaggatcacctgagcttgggaagtcgaggctgcagtgagccaagattgcaccactgcactccagcctgggcaacgagagtaaggccctgtctcaaaaaacaagaaatatatagtggttaatatccagcataagataaataggcaacatagaacaggttcaacttgccctttgtcctaaaaatatttagtccaaaatcactaaacttccaatcttgtgcttatccaaagaaagtcaaaatagttattttaatgaacacccaaaatctaataagtatggttactaggtttatcaaacaaaaatacagtatatcacattaaattttaattttagataagcaactatactatttttagtatactgtatgtcccatgtgatatttgagatatgcttatctcaaatatccaagataatttttatttgtattaaaaaatgacttggtgttttcttgaaattctgatttcactgggcttcctgtatcttatctggcaacttttataataagccaaccccacattgtgatggagtaattactattaaaattaatgtgtaatgttaacaacgataacagttaacattgtaattgcatttgtgctttgtttgaatagcgtttttattgaagcaccacatacacttaggaaagtgcacctgtcctaatccagctccatggcatttcacaaagtgggcacacgtggtagccagcaccctgatcaagagggagaacagtcatggcctctgagagcccctcatggcctctttcagacactagccttacctccaggggaacactactcctgatttaaaatggcatgaattagtggtgcctgcttttgagtcttatacaaatgtgatcgggttgtactttaaaaattacaaaactctgtgtgtgtgcgtgtgtgtgtgtgtgtgtttatgctttctctgaatattggattactgtgtaaatccacatttttggttagacagtcctcatgccccacccgtggcttttcacccttaccagttcagttcccactggcctgactgccaacagccaaaacctgcatttctttgtctgggagctcctcttggtcacaaaagcccacattttctgcccttggggtaggaggtgccagagaatttacactcctaggtgcagctctcaaccaatgaccgatggaagtgggtggattaataccccagctccctctcctctcagaggcatgttccatccacatggtcccccagagatccccactaggatggagtcccagttgcccactgccatgacttggttattatcttccttccaccgcctgcctcacttccccactctcctaacaattatcctagaatcacctcccaagataaactatttgcactcaaatctgggtctgtttctgggtgaatccaagctaatatatttggttaaattaaattaccctaaatgtcctacatttattcaacaaatttgtatcaagtacctagtactgccaaatgctgtgccgggtgctggcacatcaatgcctggcagtgaatgcagatatccttacacctggtacccagagtgggcgaagggagccaggggcactgcagggaacagccctgtggcctcaagtccagcattttcttccctacagcagagctgactccctgtgaattctgatgtgtgggggaacactctgaactaccaaattttgaaggcctagcaggcaataacttacacttaacatgaaaactgcacataattttgtggatgattgagaaggcatgtctgagtcctgaggcatctccaggtcattatgagcatccgtggttattgttcagcaagatcaatgaagagcactcaagagattattctatgtctgcactgtcctgatatggccttgtttttatttaaatctgtctccactagaagcttgtttatttgtcatttgtttttctcacacaaaactagaactcaaaatgagttttctttaaaaaattagatttaaaatgtgaatttattttgtgttcctggttgggaagattaataagcagcagttcactgtattttgcaaaagcgtgtaattgtctttttacatagcccaattattactgtccattttcgatagtgaacttctagaaaacaggagccatttgtatttcagtgatttttcccggcatagaagttttttaaaagtgtacttcatgagcagacagtagtactgagactgccctgtgggaggaaaaacccacatcaggcctgtctgaacttcagcaccacttggtgtcctcagatggtttcagagacaccccagagccccatcctcactgcagatcaggtggctgtgtttcctgagatgagaattggctgtagaaattgtgtcagctcaaaagcttggaacaaaactcatgatttctcaaatcccttttccatgaaatttgtgtgaaataacaacatttctcacagacactaacagttttatgttttatgttgtgtaactattatgttgttttgtttgcttcaacagtttttttttttaaagcaaatactcacaaatcgagaatatttgtgcctttttaaatgtgccggtaatgtcaggttatattgttcatcaagaaaagttatcataaatattatataatattacagatacgcaatctatcttcatatatactatatgtatattatcatatataaaaatagctgtatatagattcacaatgcatatctgtacacagaaaatatatggttttatcataaacaattacttttacctcctagagggagccagaattccagaagagaatgtgttgttttaaaagtgtgaattattttttgcattatgccactctgaaactaaatgaaattataagaaggaaactgaagctgcatattcaatagagaatgtgtgaatgcattccataaatagaaaaagaaatatcaagatgaaattccagctgggtgggattcctaaagctatagggggaaaatagagtctctggctgaatctgtggaggagtggatgggcttctgtaatctgcaccatctatgttattgaccagtgaggtcaaggacagaattactcactgttggttttctactgggatctctaatctggtctcttagccagagtgatttgactttcttccctgcaatcattttgcaaagggctacagaaggtgacctgtcttctcatcaacctactgtggcttgggggacacctgccaacagatgcaaagagcctcccatttgatgcagagatgctaacacgccccctctgccaggaaatgtgttcagggctgagtcacatggtttccggtcttcatctagagataagtgatccttcactgagaggcaaagggaaccacatggagcccagaagacgagggtattcatgtttgtgaaacagtgaaacattcaaccaccaatgagctgtagtggtgttttatttttgtaaattgaactggccaaatggacaggtagtttcagtgtttatttaactgattctctccctcctagaatatatccatatctagaatatatcccttccatatctacattcctatctatagtttttatagtaactctttttttgctttgatcacttacctcgattctcttgaaagcagttaattttaaaatgtagctgtggtcactgttttttgttttttttgtttgtttgtttttgtctctcagccttcaactattctcttttttggctacaatttctattatacctgttctaatggctacagtagtgagggagaaaggaaaatccccatgggaggcagtcgcaagtgggtgcctgtttttcacctttgcctgtagtgaagcattgtagtatagtgtctgggaacagggacccaaggcccaggcttcctggattcaaatcccaaactctttcccactgctggtattaccaacctggcttagtactcaacttcatcaagatcaggtttctgggaaatgagggtaagccaaatggtattgggcctctgcaaggatacagaacccttctaaaccctcttctttgcaggaagggtcagataaatattgcttttgtggtgaatggtggtgtcagaaaggtaaatcagaggtgggcatgagttcacgatcacagatctcactgtaagtaccatagaattgtgaattatttgggtgtatgcctttctaaattccttctagagtgtggaaagaattctttggtttgatgccttcttacctgtgctccagtttgtcacctctatgcaaaaaaaaaatgattttgctaagggtaggctctgaatatgcggctgaaatttgattacaatccagacattgaaaactattctatttataaagaagagaaaggatatcactatccacccacatttgacatctagacctagtgcaagatgcatttcttgcagaagtaaaactaagtggataatttgtgatatattttcctatttttattaaagttatatgggcacagagcttaaagacgcaacccactctagaaagcttattatggaaaatagccatcttccagtcccaccatcaccatttccccactcttctaaggcaactgctttccattagtttgcctgttcctgatatttgctcaacatctctaaataacctgcttagatgacagctacttgattttttcagttaccggcattctccattgaattcacagtatagaagaggagggtttacgtctcttttagcccccccttctcactacccagcccccatcttcccctaaagaattataagtttggttagacaatattctgcttagtttattattactatacaaccactcttcatagttgagccattaatacacaatggttcatcttctttggagcacagttctgtgtttaccttgtggcttataattgtcttttttattgtttgcttgcttagttttctatgttctattcttagagctctccaatcttctttctgtacgttcaaaattatcaactgtttcatcaattttgtccttctggcaacattttttctgtagtcttctgagtcactccagtctggctaggttgttctctaagcctgctgtaaaagtttcattttggaatttccttttatcatccttctaaattctcccttcactgtcattctagaaatcccctttaattatcatcatagattctggttgcttggtattatgttttattgtaacataattatatgtaacaagtgctttactcccttattttggtggagtacattctccagtagctttttcagaaaggacacataggaggcaaattttttgagacaactaaaattttatttttattcttttctcatttttaattaataatttgattgggcatagaatttcaattgttttcctttctaattttgaaggcatgactccattttttgctagctttccatgtctttgttgattacaaaatgtcattctggtttttattatatatatatatatatatatatacacacatatatatatatatatatctgctttcctctcctctgtctggtaatttctagggtctgttctttgttccagtgttctgaagatttatgattatctgctttgatgtatgtcttgttttgtttattgtgcactcaatgaaataaactcagaggacccttttgctatgaaaatgcatgtccggccaggcgccgtggctcacgcctgtaatcccagcactttgggaggccgaggcaggtggatcacaaggtcaggagatcgagaccatcctggctaacacggtgaaaccctgtctctactaaaaaatacaaaaaaatttgccaggcgtggtggtgggcgcctgtagtcccaactacttgggaggctgaggcaggagaatggtgtgaacctgtgaggcagagcttgcagtgagccaagatcacgccactgcactccagcctgggtgacagagagagactccatctcaaaaaaaaaaaaaaaaatccatgtccttaacttctggaatggtttctgaattatttatttcatcatttcctccctctgtgttctctgttttctggaacttcaattcttcaaatgctggatctcttattttctattaaggtaaagaatgagcattaactgggctgtatgaagtaaggaaggaggcttgagattaaattcttaaacagtcttttgattgttctgttttcaggcctatctttattctaacttttagaacattcccaattattcttctgctttccagcttcaaaaattttgttgttcttatcagctcttctattccttttgcattgtgggtttatgtcctgatcgaaaaaaccctttagtattatcttgttacggtataacaagaacggtaatggtatgtactcaatctgtcgtcgttaactaaaagtccaagtaatgtgttaaagaaattcaaaattgatatttgccacgttttaagcccatttgtctgattataataaagtgaataaatacaaccttttatgacctgctggaaaatgaacaatttagtccaatttaatctattgcataaatggtgagtgatgaccacagattctaagagtttacagtactgagagagaatgaaaaaagggtaaagaatactttatatttattctaacatgatttttctgatgtgaattctcttcttgacaaccctgtcatgtgtgacttagaaatgcaaatgcttcacctaataaggcaaaattagcaacaggaaataactaagtgttcatataggaagtggggaatgcgttaatggaaagagactggccttgttattcatttatggtcctatttaagtcatgcctttcatgttatttgcatccagaaaacctctagtttgacttggtctgatctttatagacttgcacagcagtcggggagggtagaggctcagggattgcatgtccctggggtccctttttcccactgtgtttggtgtagcatgtgcctgtcattgccacggctgagagtgttgacttgtgctgtgtcttttttcacttactacgccaagggcaaaggtagccaggcaaacatcctgtggccatggggtagtcgatactcctctagggaagggaaagggacttgccagtgacaacccttggaacaaggtgtgtggactctcccagacttatttgtaaggtctgccaaagtggacctacactgtaaacagataaaaatactaaatatcccttaataagagacttagaagaactttcctgggagaaatgattctttctccagaacagaagcctcaacctgacacccacagctctttcccctctcctcaaactctcccgaccacctccagccctggctcctctgcccttctttgcacctagcagccccctcctcttgcagggaaaggctgctttagcctccagcaatgtgcctatcagcttcgtgtcagcagagccagcatctctttaaaaagggctatctccaaatgccaagaacattttcccctggatcagtatgcaaatcaatctttcaaagattctgattaaaccgaggtcaaatgccagcaaggccaggcatataatagagatgagggaagaaggtctggcagagacaggcttgtccacaccccttctgaagggcggcagcagcccagcacatgttgctcactccacggggcaagacaggctgtagcagacgctagactcatggcaaaggcacaggttaggattgctcctcctatccccttgatattagggatgtcaaggcaggcccgttcctggggggatgtgagactcctctgataggcaactttgcattgagggttccctgggcctcactgcaccttcctcagactgcgtgccagctaggacagtgcacccaaccatccctgtctccacgggggtcagacccgcatcacagttggacaggctgcatgcccagctcccccgatgccccattttctatcaccagttgtttcccgctaacaaaattgttgcaggtttaattgtatcttcatgtctgcctctcagaagatccagactaatatgcctaaatacttgaataaattccgattgattggcagattgggtgcaggacaggaggcctagacaggaagctggctaaacctgcaagagtcccgccatctcatttgtacagtctatatcctgtttgactttgtttcccttgtcctgcaggttgtggctctttcctcctggtgcctgctgagggattctatttactacacgctgtctgtgatcgcgctcatcgtggtgagtcactctggccatttcagctcccatcagtgctcttttaagcaccaggggtggtgtgaggctcctccacatggagttcactcgaggtcaccggtggcgagtgcgagatgcatgtctttgcttggaggcagatttatttctttcagctactttgatcacccagaactccagcctgaccaattgctggtcagagccggcatttagacttgggttatctgggtctatgagagtccatggctgttctcctgagaccctcgtgagcatggctcttctgtcgcttcattggcgtccctagctttggacatcacttctcccccttctcactctgtatgctctgccaggactccctgccctcccacagagcccattaccgtggccacctttgtgccaacacccacacatgtcacttagcagtgacacctccctgaggtccagtggtggataaagaactctctactagacatctccatgccccaactcaacatgtccctaaatagaatccttttttttttttttttttttttttgagatagagtctcactctgttgcccaggcaggagtgcagtggagtgatcttggctcactgcaagctccgcctcccgggtcccaatgattctcctgcctcagcctgccaagtatctgggactacaggcgtgcaccaccacggctggctaatttttgtattttagtagagatggggtttcaccatgttggccaggttggtctcaaactcctgacctcaagtgatctgcccgtctcagcctcccaaactgctgggtttacaggcatgagccacagcacccagtccctaaatagacttttgatgttttccccaggacttgcctttctatatatttcagtcctcgttcctatcgtagccacagactgggaatgagattaaactgacctttccctcaactcccagcatacccatttggcttaattgtaccgtgaatttcaggttaccacaatctgtccactgcattcctccagagcccacttcagctgaggctctctgcattgccggcctgacgcagcagctgctgcagttcattgcgggtcagtgtttccatgcagtgcatctccaccacttactccccgcttctctccaccccagccagtcctcacggccatccaagtggtgtctccataaagaacacctgcaaatgcttctatcccttgttcaactgctcagtggctctgtgtcatttgtggggaaaaactcatactctttagtgtggcaagctgggctgtccaaaaaaaaagggtgaaaaattgggaagaacattgaaataggagtcgggagatctgactcctagttctgcttgcccctttaccatcatggttaattttatgtgtcaactcgactgggctaaggtgtgcccagagggctggtgaaagtatttctggctgtctgtgagagtgcttttcagaggagatcagcgtttgaatcctagaagatcaccctccccacggtgaatgagcatgattcaattcactgaaggcccgaatagaacaaaaaggcagaagggtgaatttgccctttctgtttgagctgggctatgaatcttctcctgtcctcagacatcagtgctccaggttcttgggcctttggattcaaattgggacctacagcattggcttccctggttctcaggccttcgggcttaaacttgcaccacaccacaggctttgtagatggaaggtcgtgagacatctcagcctccattgtactgtgagccaatccctcacagcaaatcttcattttatatatatatatcttttgttggttcagtgtctcttaagagccctaactaatacagccctcactggctctcatgacctgggagaaatcaatctctctaggtttcagttttcttacctacacaataggaatagatcaactaaagggtctactcacctgtttgacaaagctcctaccagtagattattttattgtaagtctttatacaaataaaatgaacatgagggttgacgtgagattttccctgcggaaccagacaggtacttcagtgaccagcagtttctgacactgaaaatcttgagtttacaaaccatcacaaggtttgccagcaagtcaatattcctttaaaatgtgctttcaattttgtcctccagtgtccccagattaaaacaggaagggaactggacctaccatgctcccctaattccagggtccctttatcattgggagggttagaacccaccccacagagcagagaggttcatgctggaactgaagacatgcttctgttaggagatttaaggacatacatgaactatgttcttattctgttattacctgtgaaaagggtatgatcacctggaacccaaggactcttcccaggcttctctaataccccttccagcaagcttcatccttctatgcacaaacccacactgactgtgtgcactctgctcttctgccattacaggatgttgggatgatttttgaaaaaaattttttttcaaaagacatggttagggaacagtgtcaatgaacacagccctctactttgctgaattccagaaggagacgactgtgctcatgaagacaaggtggtggaacagaatggagcagatttggatctcctgggagcacagacttaaccacacactcccaacagcagttctgctggtgttggcttctttccctgttttccgcatagacactaactggactatgtgtgaaatcacttgtcttctgttcagtgtatctggatatatcaaagataaaatgaatgtaattgttgttaatgacgtgtgaataagtaaagaggttttgcttctttgggctttgagtaactccctcacccgagcctggtctttgggcaaagcaatcatctgccctcagggtgcagcatataaaccccagagctgagctagctgaacacgcaggctgccagggcaactccatatttcattcagacagcaacaaaccacataagcaaatgattctttgctgttacctgaagatgtggactgtgtatttacagaccagttgtcaaggctagagttttgtgatttgagaaaaattacatctctccactgttaagaagaaatagaaaagataaagtttgagtcctcaaggttaggtcttggttctttttactttaactggtgttcctccaactttagtctacactggaaacacccaggatgcctatttagttcaacaggctcttgggtagggcctgggaaattgcattttaaccaacatcttccctcacccacaggtgattctgatgccactagcatcagagaaactgcaccttgagaaacacaactttaaatatggctggaaaccatttccttggggtattcatctgttgcatagaaatgataatttctggagtcagttttcagattcccaaaggaaaggaatcatagcagcctaagtaactttagttgcctggatttctgactattgctagtctgagtagactcttaactcttgttaaatggtggccaaactcccagggtcatttttccatgaaatttgaaactgtccatgaggagtaaaacagagtttcacactcaaaagtgctgcagttcacaaagtacctctcacaatgtctccatatctattccatgcccccagccagaggctacaggtcgcacgcactgtcttttttcttcttctcctctttctgtttcccctaatatcatggtaacaaaatcatttttcttctgatttcccttaggtaatactaagtttctctataggactctgcaatgagcacttgaaattcctttatttaaaagcccttcctcgtacccaccaaataattaccaaccttcccaaacaatgcattcaactcttcgggttttttcaaaccactctccctattatacagcaatgaaatgttcagaaggcgtgtaactgtcggtgtcctgaggttgtgtaataaagagctccttcacccagagggcaagtcaggattaagcaggaccagatgctgttctgtgtacacgcccaccaaggggttcttcagacctcagcagaggggccctggagacaaaccatggggcctggagacccacagagaggcatggcgacttctccagagacgctgatggctgctgaggggccgagggttcagaggagggtcaggaaagcgccaatagagtccttaagacctggattcaaaatggctgaaatgtcagctgatgcgggcggggcatgccgaggtggacaaccaaaaccacaggagcaggaagcgcacgtgcattccgaaaccaacagagctcagaacagttcactcggacggagacgtggggcgatccacttccctattcgggtatttcacctaaactttcctctgtgctattttctagtttgcttgtttgaaggagaagcaaaagaaatgaattcagtcattgtctaaagcaattataatttcaaaaacataaagtgtgtgcttctcggggcccttccccagccccagtcaactttctcttagccctggtgacattccgtactttgaaacatctggccagcggtggagaggctggacaggggctctgaaagcgttgagaaggctcccccaatgccttcagtctctttttgcaagacagacatcaccttttaaatcctgaaagagttctaggttctttagagcccttccttgtgcccattcacccaacagccaggtgcaaattattgcagattcttcgctgcttctcctctgcccccagtgagcacttcaactctgggtatctccggcctcccagtcctgtcttttctccaaattccagcagacggacagttttttgtattgaaatgttactgtaatttacataatgaggtaatttacataaatgcaaatgattcattacataggcagtctagcagctgctctaaaagaaatactttatttttacctttcgtctctgctggaggacggggactgtgaacatggagaggagggcagccctcaggggaagcagataggcctatgggacaggtcccaggtaacgtgggccagcttgaaactccaaattcacaagtgctgtctgtctgctgatgggtcaggtgagcccttggcagcagtttgggggtcttcagggcaacctgaacactggcacagcagcgaggttcctttacaccaacacgtctccttccttccctgggacattcattgtcatggcaccgagtgaatggaacccagggggatatgagagagttcagctgattcacctgccacaggtgcccagcacttctagcagaatttacatggtgatagaaatggcctacaatcttgtgctgtccaatgtggtagccactagtcacacgtggctactgacaggcaactagtgggaccaaggaactacacttcttatcttattaattttaatttttaacaagcatggacttgatcctcagcaggggactgtgttgggtctactgataattactttttagtttaatactcgtgactatgcaagcaagctattttgtgagtcccacgttagagatggcatcaccagggctctggtggttaaatgattcacccaaggtcagggaccggtaatacctcgagtttgccagagcaggtgtctgacatggtgcagctctactgccccaatatagaatttggactttccctccaataaaatcctcctcttacagtctttaaaatcatcctaccccaccgcccactccccctgttagagacgagggttaccttcacttactttgtggtctagtttttaggcagaagggaacagctccagccaccccctgctagaattttttcattaaaataactaatctgaaataatctggaaatgattgtatcttgccctttctgtgatagagaagaaatctcagaggtcatgtggaagtctgtccatcaccggcagctggctgacctccaaggccctgcccctctgacccatcaccctcccctcctgcacccatttttcatgggaattaacctcttctctctccaatttagaaacttggggttcttatttttttatttcaatggcttttgaggtacgtgtggtttttggttacatggatgaattatatagtggtgaagtctgaaattttagcattcccttcaccggagtagtgtacattatacccaatatgtagtttttgtatcccttgcccctcctcccacccccccaccttctaagtctccaaagtccatgccaccacgctgtatgcctttgcatacacatagcttagctcccacttataagtgagaacatacggtatttgattttccattcctgggttacttcacttagaataatggcctccaggtccatccaagttgctgcaaaagatattgtttcgtttcttttcgtggctcagtagtattccatggtgtatataaaccatattttccttatccactcgttagctgatgaatactcaggttagtttcatatctttgcaactgtgaattgtgctgtgataaacatactcacgcaggtgtctttttgatagaatgatttcttttcttcggggtagatacccagtagtgggattgctggattgaagggtagatctactttcagttctttaagacattctcatactggaaaacttgaggtccttcagctcgttgtgccctcattacatttcagccctcaggtctttcagctcattttgccctcattacatttcagctctctttctggcaaagtcggaataactatggtagcaagaagatcctcaccgagaatgactttgacagaattttaagatccttaaacaaatcgactatggtcttacaaaggtcgcctgttttgtaatccctgctgtcaacaggaggaaggaaagtcctgctttaatgacactgggtaaactaggaggccggttacactctcatttgctgcttggacagggaagtgcatccgctggcctggagaccccagagaggagcctttcatctctaacaaggaaaacaacgtggaaactgtagctatgtgcttgattttggttttccctgcccagcaaacatagtcctttcagtttaacaacccccatctcctatatcctcagtacttgcccttttttctttcctgtagcctgccttcatatatttatacaacatgatcagctcggctaaagccctgcccgtaggtcattttttccctgcccttctgcaaccacaaccttcatcaatcaagcctataagacatcctgaagtaggaatttctgcttaactttgaaatataagtgatactggtgcctaacagccagcttcccagtgtattccactggatccctctcctcagatgaaatcaccatggccttagctaagccgtctgcacccccacccaagagctgaagaagtgagaactacacccactcaagggagttcccgtgatattgagtgggaaaagtctacggggggctgttttctttgcagcaaggaaggaaagagtttcaggtttcagtctcttgaaagaaaacgatgatgttgattttctcccattattttcactgcttaaaattctcatggtgccagtgattacaatacatgctatgaagtcttagcttcagcaatgcagcctctcctgcttcatggtgacaatttacagtaagcaaacccaggggctgacatggcgatgttgagacagccacctgcctcccagctcagccagcctcttctctcccgcgtatactaggggctcctggctcttcctcccctgctcctccatgttgagcactccattcccttggcagctctctgggttgttctgatatccagggattcgccggcctgatgtaagcccgtcttgcttggaagaattctggagcagacaccaggaatgaaaagccggtttccatggtacccagccgtttctctgaagcctggaggaaatgagtgcttttttcaaattcattcctgttgaacatttagctcagcagcagaacacgtggaaacctcagggcgaagccaagggtatctttggatgaaccacatgtgggtcagagggcagaggccccctgaccagctggtgctcagcagatctgagatccagctatcagtatcacccttggtggtctctgggctatcgcagagcctggcccccaaacagaaccaacagggcacagagagaagaacgcttacccaagggttgctttcacaaatctgatggggaagaagctgagtcagttccaaagcccacaacaggaggtccgtcaagtgcaactcatcgttgaggacagagtgttgaccccaggacagagcaccaggcaggacctgcccctggaacaccaccttgcctcaagacagcagcggctaaagccgccttcagtaggctgcctgccttgaggtgattcccttccttccaggagatttaatagaactgcgaaaatggacttgaactgacttcatttcaacttcactaccttggcaggctggacatggagggaggactggaacgtgagcaccacttagtggtcatttgcaggaactgcgggtgcaacttgttctagtctagaaagaaatgatttcaagttttcttctacactagtaatacttatctaagggatgggggatgttgctttgatttcttttactctcagctagtagagcataaactacagagggatacgcaacacgtgtcttaaatgtattgaataacatgaaatctttaaggaataacaaattcatttcctaaccttcagcaaactcaagtgaaaggaacctcatccttgccgtttgtagagttttctgagggagcgattcaaatgctccatcaagatggtccagcaaggtaccctcccgatggaacgttctgcaaacagcgccagtcctaatttccagtcttcggaagaggcgatgaccagctgcttgttctccaaataacagcactgaatgttcacaggcagttgatagctcatctccaccttctttctcatgatgaggaagccctgcttctgtttagagtttttttagagacagggtcttgctgtctccccaaggctggaatgcagtggccagatcatagctcactgcagcctcaaactcatggctcaagtgattctcccaccttgatctcccaaggtgctaggattgcaggcatgagccactgtgccaagccaatttagattttctcagagtcctgatttctagtcccttttgttcatttcattgttcttttctgagtcctctcattcctccacacagtcctctcaaaggagaaggataaacccgaatgatatttgccatcagccacagggtagagaagccctgactttgtggaggcctcctcctccacctcctcctcctcctcctcctcctccgccttctcatcctcctccacttcctcctcctcctcctcctccgccttctcatcctcctcctcttcatctacccttatgcattctgagtgatggggcatcttcacacaaggcagagatcaaaggggaaactatatcagttatttgcatgtttccggatctcctccattagttagtacttgtagtgagatcacctgcatttctctttccctgtctgcctccctgaaccatatccccaaccacagctccccaagccacaaccatcctcttgactccagggtcatgaagctctggacctaattgcatattttgtccaatctcacccggatttgcccactgtttctctgattattgtgctcctgtttggggtccctcctaaaattaagcccaatctcattttttctttgctatgatcattgaaatgatcagtagctaaagtcctatgaatctcagggctgactgctagcagacaggaagagtactttcttccagggtgagcgatctccaagcttttcctttgcagaatctgtgccccacctatggggaggatcactcagaataagggctttctaaaagctgctttcatattctatgttattgcctgccttccctgatagaagaaaattaaattggcctggtctaataaactctttctcaatatcttctgttctcttaagtggctacaaattgattgttccagcctgctgcaaggactaatattgaattaacttcaattaatagaaaatgttttctatcttaaataatttgatctgctccatgattttttggcaacaatcttttttcaaaaaagaaagttgggggggttatacaaaagagctgtcaatgccttctaggggttgggtaccatgccattcaacctggattatgagattgttgcctttatttctttaattctctgcccattctagtttgacattgtcatcccaatgtcaacttgttgaatctgataataaagatgaaagtaacaaaaatgatgaagcccacatttccaatggcttgttgggaagaatgagttacaaatgagcacagctccttcctcctcatcctcattttgaccttcaagataattggaaagagttgctttatgcgctttgtgactggtgccctgaggtgttctctacgtctctacccagctcatggttactgccctggctggaggctgatgccatgcccgctttgttaactgagtttcccatctccaagttgtgatggcagttgacacccagagtgtcctgcaagtgtctgcttcagtctgcagagggctgctgcctctaaaggaaaggccgctctgagacgaccatactcaaagcagttgtccttcaggagtttgagaagaaagagctatgaaccatgtcctcggcttcctacttctatgaaatataggtgtactcatttggtttcggcaacatgtcatcagccatgtgtgtcatgaaaaggacaccaaattcggagctggggctgagttctcgagccaattctgcagcaaatggagcaagcctaggaaaattacttatgttctctgtgactcagtttccctgtataatcaaaggattacactaggcttccccccatgcccccacaaggtgggaaatgattttagatggtatatagaccaggacttcagtagattaaatcctgccgtgtattctctctgtattctctttcaagtcctaactgatgagtaaacctcagtggggtgctagtgtgcctttgactgcttctgacccctaataatcttccttagtgaaagggcaggaccatgcccagggcttgggcgccaacagtgtccagatgggatttgcaaacaccatttgttgttaatgcacttatttttcggggtgatggcaaggagtgttgatcccctacttctggttgtgatgtgaagtttcctttgaaaataaattattttaaggaaacaaaaaaaaatcaattaaaagaaaaaattgagcccatagaagtccaagcacttgcataaaaactgaagatgcacagacatgcagaaatcttacagagactaatatttggaagaacctgctgagctcctacatccccttgcagatctaagattctacaatgggccttgctttacaaagcaggttagtcacacttccctgtcactctgatgttgtacagaaattgcaggaagaagggaattacctgaggctgttcttttccacacatgcccaccctgatctaccaacacctccttccactaacactggccaaaggccaaaccagtacagagggaagtttacccacagggactccaggtcccaggacaacccagtcctgattacaccatcccaggaacaaggtggatactgcgtgcagccttaaagcgtgtgtgtgtgtgtgtgtgtgtgtgtgtgtgtgtgtgtgtctaatcttctattctttttattttttcacagtttatttatgatgaaaaagtttcctggtaagtacctctctttccccttctcatttctgaatgttatgttgcagagccaaatatattgaagaccagtgttgggattcaagaaagaaagggaagtgtcatgacagcttagaatgaggagaatttcctaggaaccctctgcacacctcaggggagaaattaaattcattttcacagagtcaagacctttcctcttgggctagagtggtggggttctatttgagatcctaatatctaaatgtctttattatcctatgtctggacatcatggcttagctgtgtctttctacagtcagccatgtgctagggtagagttaagatttgactgatttttgggccgggcacagtggctcatgcctgtaatcccagcactttgagaggccgaggcgggtggatcacgaggtcaggagatcgagaccatcctggctaatacggtgaaacctcgtctctactaaaaatacaaaaaattagccgggcatggtggtaggcacctgtagtcccagctactcaagaggctgaggcaggagaatggcatgaacctaggaggtggagcttgcagtgagccaagatcacaccactgcactccagcctgggcgacacagtgagactccatcccccaccccccaaaaaaaaaattgtgtccaaaccaagctccatgttcccaatcccacgtttatcttaggaattaggacccaggcacttctgtgaccattaatccattaaagttccccctgactttcaaaagatcttagagctctgaaaattggtgttgttggggatgttttattttgatagaaactgttgcccaaattggcccggcatggtggctcatgcctgtaatcctagcactttgggaggccgaggtgggcggatcacctgaggtcaggagttcgagaacagaaactgttgcccaaattaaatatatggcaagacatttgcatttggtccaactgttcaaatcctcgttttcgagatgggttctgagcaaatcaagcatgtttgaaatggaaatggaaatcgagtgtattgtgcattctcgttacatattttccgaatatttgatctacagaggtaagcaatgtgaaataacatattaggaataggcgtaggtagaaaatctccctggtattattgaaagctgtgaatgagccagaaaaagtagagtccaccaggcttcactttcagcaaaatgactgctaactctttgttggtgtgggcctctctgtatctgaggacatctctgactttcagaattagggggcagtggagaacccatcacattgatgataaatgttacttgctatgtcaaggtattaagatacttttgctaactctcctctttgcaagaagaaagaggaggagacagctaggagaaaatgagaaggaggtcttctttgaatcatagtgaccaataggctgaaaggaattgacatgcccaggagcaccccagatcagagaacctccttgttatatcatcctggaggtggctgccaaatggagtgaggggcatttttcccccctgtccttggggataaagtgcagcacaagaaaacttccagaagctgatggcgtagttagcacaaccactgctccgccttagcaaacagtaggtgcttcaacgttgctcagtggtgctagtctttgctaatgacactccccaaaagacaaacaagttgtgatcacagttgatctcagaaatgtgtgtgcagctgttgtgcagaaacatgttaggaaaggctacccaggatggtttgctgtcagccttagagggagccgtcttttctaccacctccatggcattgctgtatgaaagccatggcaagtgaagaaagcaggcttcaccatcagcccatttcactccgtatcctcaaaacatctcgggatagttcagatggtttggagcaagaaaaggagtgtctatttcatcttcattcctaagtttttcccatgatgttaggtaaccccatcctagggtaggtgcccgaggctgcagcagaagggtctagattctggaaggtacaagtcatcagagccctcgccctgagcaccgaggctccctctcatccaattatgagtaagaggcttggagggccatggatacatgagttgcaaatcccctcgtgtgtcttgatctatctggggggcattggaatcataagtcatgcacagttgtggcttccagggaagaattggcctgggggggccttggtggcaccagaactacattcttcccagagcactggcctgtcgtgtaacttgttattacacgcatgggctgatgaagagcattttgcacgtgagtgaggctgagaaattaaagtctgtgccactggcccttatctactttgggactcccggggatttcaacttctcatttaatggatgaaaaataatggaagtttaagaattttttactgttcacttcttctatcttcttaccaagccaatcatgaccatttattttgctgaaatggtgcgtctaggtgctgatttctctctttaaaatcagagtcttcagtctgtgcaattaaagcacagtaacattttgaaaatacctttaacagagagttccattcctcattatagaacattccagcatggcctagagatttcaaggcaggtaaccagttcaccccaaaaaatcttcaaaaggaaacaaatttcaattgtgtttatttcgaaactacagtactctttaagaggaagtgagctttgtcaaatacaaatacaccaggacaaagtacccctgtcatgcagttcagattctttcaccattcctgaagcagcattctgcaggaagtcacattcagtcaaaaaaatggtggttgacagttagtcaggattgattttagtagcaggtactagaagaaccagctacagcgtattgaatacatactggtgtatttttcttactatcagtgccccggatgtaggtggtgctgtggctctgcatttcccctggcctttgcctaatggtcccaagatggctgctgcagccccagccaccaagttcatattgaagaaaggaaggaggaagaaggggcactgttgttctttttggcacacttccaccttgcatctctttggtcgcagaagggtctgccttgaccactgagcagccagggagattagaatgaccactttagaccaatcatgattcatgctcagggcctggggtcaggcgcaccctctttgagatcagaagggctccatttgctgcctcaacctagtgggtggggttctcttagcagggaagaggcaggggaatagtggtgagtgctcttcggttaggtgcctatgtgctaaaagacacttgacataggaagcatcggcaggtcatggtggctcacgcccataatcccagctctttgggaggctgaggcaggtggatcacttgaggttaggagttcgagaccagcctggccaacatggtgaaaacccatctctactgaaaatacaaaaattagccaggcatggtgatgcacacctgtagtcccggctgctcgggaggctgaggctggagaatagcttgaaccctggcagcggaggttgctgtgagccaagattgtgccactgcactccagcctgggtgaccgagcaagactctgtctcaaaaaaaaaaaaagaaaaaaaagtgtcagaggcccacatattaggatgtatgctcgacccacagagcattcccgtgttgttgccagaaggaattcggaatgtgtcttcagggagtctgaaggcccaacaagaaaactaaagaacgcagggcgatggtttggtttcttcttttgagtccgaagttgtgactttgggagagaaaagagaccctgggattgcaacctggaaactcttcttggtggggctggaaaacagcttttgctgttctgggatgtgttcaggaaaccagagccaacagtgtacccaggtgaggagaggagcagtcctcacatctgagaaggaaccgtctttggtgagaatcagggacccgttgaaaatgattcaaaatggaagcctggggagggaagaaacaaacccagatcagctacagaatgggatcctcagaggacagcgggtgaggtgtgctcaggaggaaaggggagaaggtgcccagcgtcctaggtgaaagggcgagaaaggggaccaaggagggccgggtgacttccaaggtctggatgcttcctaagcacctcctctacgccagggaaacatgtcgtacaaaaccagagctggcccgacctggagctctctcaggctggagggatgcagacccttcacatgtaactgtgggaccacatggagaggctcaccacactgaggagagggggtggggggaagggccctgaagagcattaggccaaggcttgatgatccaaattcaaccaggtcaaaaatgcatgaggaacagcaggtggggcggcacagaggcctcctagagcccactgggttcaatggggaggaagcctggtgagccctgtgtctgaaagccaacagagcaaacttgaaatgtcaacaaaagcaaggaatctcatcctacaggcatctctgcaaaatggccagagagaacctggtttgaatattgcaacagaagggcttttgatgagtaaaaaattgaaaagatctaaaagaattagaaagagcatacatacgcctgtttataaagtgctggacttaattcaatctgactacaatatttcattaaagttgattcattttctggtgacttctcactgaatctattaaaatgcatctaagcaataacgtgacatcccttcagaacctgggagcctgttccttccaaatgaatgggctgtgaataaatctcacttttcaccatgaagtgtatgctacgtatacattggtgtcgatgagataagaactatgttcaggccactggaggcattttgcaactgaaaattgatgtttggagggagtgtcacctgcacagatgagctgatggctgctttctgctggggagaagaggcaagtgggcaagacctgggggtgtctgcgtggggagaaatcagttgtcggcattttaaatctctggataatgagacaccagataccagggaaggtgtcaggtgtgaggagtggtgtcaagtgactgctagaaacaggtgttagttacataataaatgagtaataaatatataaacaagataatcacagactgcttagaggtttgaagaacataaacagggtcatgtgagagaaagtcgggcaggggcaggcagggaagattgcttggaggaggtgatatttaaaagctggtatctgcaggataaaagtggccagccaaggagtgaaggcaaagccattcctggccaaaagaacattcagtgcaaaggctctgggagagggaaagagacggctgtgtgcaaatgaaaggccattgaggtggggcacagataggacacaagacaacatggagacagaagaaaaggccaggatttgcaaggaaaaaggaaactttcattttttttcttaggcattttgggaagtaaagattttaagaagtgcattgacatgctcccatagtatcaaggaaaccagttcagaggttgaagtgaaaaatgacctagggagggcacagtagagaagaaagaagtcagtgattgatgaaatacttgagacacagagtccgatggatatgggagtgaggaaaagggagtgctccatattgatttccagattctgggcttgactgggcagggagtggtacagttgactgaaaggacaaagcccagggttggttttttttttgtttttttgtttttttgtttttttgttttaaggaggctaggaaataagaatgaagaattctgttctgatagacatttagacttccaggtgcagaggccaaatatatgaatctggagctggagagaggtgtggtgtggatgtgtaaattgggggtcattatcatgtatttggtatttatagcaataggtcaggatgaggtcacctagggagaaaacataggcaataaagatggcccaataatgagaggatgaactgaaggagtggaggaggcaaaggagatggagaaggagaagctgggggcaggaaggaagccaggggtgtggcctctcggcagtcagaagagagggttttatgaagcggggcagatgatctcctttcagatgctaccaggaaatcgaacaggatgatggacaaccacccactcatgcttggactggtgtggatagaaatcactggtgcccttgacaggtgattcaagagatcggggggtgtggaagttaggctagagaaatttgccaactgaatgagaggcactgaaacgcagtgtgcacagccctttaagaagttttgccatgacagaagctgagaaatgtggcagaaattgaaagggcttggataccctgatttcctctctcaatagtgcatctgagcactttctagaataaatacctacatctttgcataatttgttttggaagggagatggaagaaagggttttactgtgtcgcccaggctgtcgtgcagtggtgtaatcatagctcactgtagcctccatctcctgagctcaagcaatcctcccgcctcagcctccccatgtagccgagactccaggggcacaccaccatacctggctaattttttaatttttttctggagacggggtcctgttatgttgctcaggctgttctggaacttggggacataagtgatcctttcctctcggcctcccaaaatgctgggattacaggagcgggtcactgtgcccagcctgcataatcattcttaatggatacatgaacctacgtatcatttatgtacccagtgccctattttataaccacctggcttccttccagcttttcacttttttataaacactgccgcaggaaaaacccttgtgtatgtatccttttcacatttgaccaaatatttctctaggatcagcttctagacatggaatttgaaaagagaaaaggaaggatgggtataacctggagtttcctcatctgaccattctccagtaacctaccactgaagccaaaattactccctcaatgagctgatttgattctgtagctaaagcgaaacctggaaaacaagctcctggtttttagttggaagccactaagataaagaaaacagaagtattcagactattagaagctcaaggcacattctagcaggtttttcttttcttccttcctgtggaatgttttcccacttattccttcttactcttcgactggtaccttccctgcccaggttccgtctgtctgtctgcctgcctctctccccacttctaccctttatgcctggctcctatatatacagcaatccctcaggcatccccggcaattcctctaattttagtttccccttgtaaatatgtctgaatagtttcagtgaatgattaagctgagaccagatgtatacatattgacctatattcagcaacgtgtatgaaaggcttgctgctttcaaagagctcttttaggtgacaaataacagagaggaaggggcattttccctttaggtgaggagagaagagaaagatggttgacagccttatgcagcatagagaatgtctctagaccaggaaatatccgtcacctagcaccgtctgccttctccttactatcctggccgtttgcatcaaatatgtctttaaaaatgaggcaggtgagtttcacagatgtccatgactgtctttaactgttcttggtttacacacaggtgggagtctttagtccttgtgctgatgtatcttatctacattgtcatcatgaagtaagtaaaatttttcatttcttatccaaaactgtttcttgcattccacattatgtgatgatgtgggaagaggattggggtgggtatctgactggtttttcagtgtgtatcatcacagtcacttggctccctgccagactgttgtgagtcactgtaattttgattagtatcaattgtagtgacccttccagcccatatttgatgatagactcaaagcttcagtgtttcacttgagaactctctagaacccctaatctctcttcaggatctggcagctctgggaggtttcttcactctctttcttaacacaaaggagataaaactcaatatgttacactgctatagagggtgagagaagatgcaaggtagtctactcaatatggcagccaacatgagccagccatccggtggtctgtgtagacccagtctctagggcttgcttgtgaagggaattcctagggtaggaccttcatcaaacatatcctggcatggagttatcatgaggtaactgatgaagagttagttaagagacagctgaaatcatggatcaaatatctgtggacttccattatttatatggtattagtcatccactgctgcataacaaaccatcccaaaacttagtggcttaaaagcacaaacatgtattatctcacacattgtctgagagttaggaacccaggagcagcttaactgcaaggttctggctcagagtctctcatgagtttgcagccagagctgccatcatgtactggactggtgtgggagaacctgccttcaagcgatgctggctcttgactggcgggctgtttctcaccacatgggctcctccctagagctgcttgagtggcttcctccagagcaagtggttcaagacagagagcaagaagggccctgcagcaccttttataatatcccagaagtcacacgccattacttctaccatattctgtttattagaagcgagtcactaagtccagtccacactcaaggggctggcatcacttagtgaagggaaaaatgtcaaagaactgttgaggtattttaaaaccaccatgttatgacatatgttcttttccctcctggagttggggtagcttatttatatcaagaatttgccaggcgcagtggctcatgcctgtaatctcagcactttgggaggccaaggtgagtggatcacttgaaatcaggagttcgtgaccagcctggccaacatggtgaaaccccatctctactaaaaatacaaaaattagccaggcgtggtggcgtgcgcctgtaatcccagctacttgggaggaggcaggagaatcgctggaacccgggaggcagaggttgcaatgagctgagatcgcgccaccactccagcctgggtgacagagcgagactccatctcattaaaaaataaaaataaataagaattgtatgaccaatgtttcccatgctgtaagttaaatgtaagcaccatggtggtaagcctgctggttcatctttttgccaggcaccactgggatgaggaggttataaagaatgcagagatgttctgtgctgcaactgcccaaccccgtgggagctgctgcttttcctctaaattagcccatgtttccccaacatatgtagccgtaggagtgactgccttctctaggggcaagaaagtagaaatccatcaacaatggccagtttggacatatcaggtggcagtctggaactgacacattaaggtttcttattgttgaggcctgacaaaagttaattctggtgaccagtgactgagacacttgttgagagaaatcaacacggacattggcaaatatcacaggagcaatgaaggtagaagctggcttggccagtgcccagggtgggctgtaggcaatctgctgccagtctactcaatatgggggccaacatttgtgaggggagccatccaatggttactgtagaccccacatctggagcttagtggagaagggcattcctagagtaggaccttagtcatacatatcctggtaccataaggtaactaatgaagaaaccagaagttacacaccgtagaactaatcatttaaaaataccaatagatgagctgtcatgaaaaccagagttgatccaaagcctttccaaactttccagcccccaaaggaaaagcctttaaagatcagagtacccatcttatgcctctttgtctcaaagagcaaaactatatagcaaatcagtgccaaagtggggaagcctcaaactactgtctgtgtgtgtactcacacatcttcctttgctgttttctagtgcatcgtttcaattttttaacattttgaggctctaattgagctcccaaaagtggattagttgattattctggaagaatcgccacacagtgtctgctctatgcccaacattaatcttgggtcttgaatcttaattttcatgaaagtatgtttcaaaatgaattcactaagggcttcagagagttaagtattcttcaaaaacagatgtggccagagagaagaagacttgaggaattttgctggcatgcatcttatagccactgctccccttttccaagccaccttgaagcccatgagtcgctggcaggacacgtgtacagtaagatagtacagcgaacacatcctctcctcttccccaaaccgtaccaaatgtggaagctaatgaggtgtgtttctgctgatgcctcacttttaccaacattccagctgttcaaaccagcaggatacaaataaaactgggaatggaagctactgtgctcatgaaattttctgcataaattctggtcctaagttctaaattgaaatctctgctctttagccatccccctctgcaatcagaggctttaatcattgggttttatcaaatctgatttataaaattgcatgcttcacaataaaatagcttcagggtgcaagcacaaaatttaaaacattcaattaaaaatataaaacagcaacagtagttaagaaaaaaaacagcatatattagaatcgtcagctgcctcctaggtggagagtttttaaatgactttaaacattctatctgaaggtcaaaaagcaatttcagattgtccagttaggtagaaaccttcaaggagcataaagcatgcctggccttggcaaggattgctttctgtacatcccaggtcactgctctaggatttgttccccagatggggtatgtgtgctggtggttaagaaccagtgcctcacattcagccctgacagcagagccccctgccactgacagtcatgggacctcagccaagttcttcagccatcttgaatctcagtttcctcttctgcaaaacaagattaataataatttctactattattatatatattccatgagaacggaatgtgacagcttagttaagctgtcaagctaagttaagcttagtttaacctggtatccagttttgagaaagccctcactgtatagtattattatcctgttctctaaaccctgataaatgtataatacatgagtttgcttttgtactttaaaagcaaaacctaatcactgggcactgtagtgcatgcctgtgatcccagctattcagaaagctggagcgagaggattgcttgaagccaggagtttgagactaacctcagcaacatagcaagaccccgttccaaaaaaaaaaaaaaaagcaaacctttatgcaagtcagtatttctttcagggaaatggagtctaagtcaagatgacagaaacactgcctctttccctgtcgctctacagggcaaggcatccttgtcgaatctagaaagtgtggaggccttttcactaacaggaattttgaatatatacaggagtctgcagaatagtacgatgaaccccatgcattcgtcaccacccccagcaaccatcaacccacagttgccccatccacaccctattcacttcccttttctcctataattttgaagtcccggacatcatactagttcatccacaaaaattccagtatacatctggacatctctagacacagctggatactcttttaggattcttttttttttcttttttttttttttttttttaattttcatttttatttttattgatcattcttgggtgtttctcacagagggggatttggcagggtcgtaggacaatagtggagggaaggtcagcagataaacaagtgaacaaaggtctctggttttcctagggagaggaccctgaggccttccgcagtgtttgcctccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttctacacagacacggcaaccattcgatttctcaatcttttccccacctttcccccctttctattccacaaaaccgccattgtcatcctggcccgttctcaatgagctgttgggcacacctcccagacggggtggtggccgggcagaggggctcctcacttcccagtaggggcggccgggcagaggcacccctcacctcccagacggggcggctggccgggcggggggctgaccccccccacctccctcccggacggggcggctggccgggcagaggggctcctcacttcccagtagggacggccaggcagaggcgcccctcacctcccggacggggcggctggccgggcggggggctgaccccccacctccctcccggacggggcggctggccgggcggggggctgaccccccaacctccctcccggacggggcggctggccgggcagaggggctcctcacttcccagtaggggcggctgggcagaggcgcccctcacctcccggacggggcggctggccccgggcggggggctgaccctccacctccctcccggacacggcggctgccgggcggagacgctcctcacttcccagacggggtggctgccgggcggaggggctcctcatttctcagacggggcggctgccgggcggaggggctcctcacttctcagacggggcggttgccgggcggagggtctcctcccttctcagatggggcggctgggcagagacgctcctcacctcccagacggggtcgcggccgggcagaggctctcctcacatccgaaacggagcggcggggcaaaggcgctccccacatctcagacgatgggaggccgggcagagacgctcctcacttcctagatgggatggcggccgggcagagacgctcctcactttccagactgggcagccaggcagaggggctcctcacatcccagacgatgggcggccaggcagagacgctcctcacttcctagacagggtggcggccgggcagaggctgcactctgggcactttgggaggccaaggcaggcggctgggaggtggaggttgtagcaagccgagatcacgccactgcactccagcctgggcaccattgagcactgagtgaaccagacaccgtctgcaatcccagcacctccggaggccgaggctggcggatcactcgcggttaggagctggagaccagcccggccaacacagcgaaaccccgtctccaccaaaaaaatacgaaaaccagtcaggcgtggcggcacgcacctgcaatcgcaggcactccgcaggctgaggcaggagaatcaggcagggaggttgcagtgagccgagatggcagcagtacagtccagcttcggctcggcatcagagggagaccgtggaaagagacggagagggagaccgtggggagagggagaccgtggggagggggagagggagagggagagggagagggagacggagacggagaccgtggggagagggagagggagagggagactcactcttttaggattctaaaaggactattttctttaacataaccacattatcgtcatacgtaaaattaatactaattccttaatatcataaaatacctaatgttcaaattttcagtggcctcacaaatgtctttttcattgttttcttttagtttcataaatatcataaatattttaaaaatgagaattcaaataaattccactcattagaattggtggcccatgacttgctgctgtgtctgtatgtgtgtgcatgtgtgtgtgtgcattttccttgcactttgttctttaatgaagtttggctgtttgctctgcagagttgcccacggttggaaagcgttgattatatcccatgatgtggcacagtctgttcccttggcctctgtgtctgtgtgttgtctgtgtgtgtatgtgtgtgcatgactgggcatctgtgtgtgtctgtgtgctgtgtgtctgtgtgtgtgtctgtatgtgtctgtgtgtgcgagtgtgtgtctgtgtctgtgtgtgtgtctgtgtgtgtctctgtgtgtgtctgtgtgtgtctgtgtgtctctgtgtgtctgtatgtgcatgtgtgtgtgtgtgcattttccttgcactttgttctttgatgaagtttggctgtttgctctgcagagttgcccatggttggaaactgttgattatatcccatgctgtggtgcaatctgttcccttggcctatgtgtttcctatatgtctgtaattgatctgattcaggctagactatgtcccaagtggtggtaaagttccatcaccaggaggcacggtgaggtctgcctttctctgtctgtagtgttggcagccgtcagcattcaggttccatcaccaggaggcatggtgatgtctgcctttctctgtctgtagtgttggcagccatcagtgctcagtgtctgcatccattatttcgtttgggttgcaaaatagtggtgttctaattctacgcttcgtgtcttatgaactacaaatgacacccgtcactttgactagttttctgttctctctcatgcaatgtagtaactgcacgttcctagagagtacaggaaagaactcatggatgagacggtccagccacagaggacctcttcgtctctctgaggtcttgttgccataggccagccacctcagagctgtacccactgaagaatcaggcacaaaggagatagctgggagggaatccagagagcttcatgtctgtagcagcaaagagatgaggaaagggaagagaaacataggttgagtggccttccagctggcaacttacggtcaccatgcctaactgccatgcctatgggaggccggaggtcaaactggaggtccccagtgggctgtcccatggccagtaaacgatggaggggggaaaagcagtagcagccttttgtgacatggaaactgtgcctggctgtctttgcccgtgagtttttatgagttttctaggattcctctgtgggaatcttctcatactaaagctagggagactgtaaaaaaccatcctcggaacttgtacaagcttcttcccttcccacctcagcctgctggggcatctaaggaacactgcacaatgtattcacttgatcattctggaggataatagcctagaattttttcataaagctaagggcccattggatctgaaacttaggcacgatagtcatagaaatttggagaatcccaacccatgacctcaggaaaccaaagccatacagagacctagacggccaaccggactgtagcacatagactgtgacacacagccactgttcctggggagtggtgtggatgaagcagcttctccttctcccaaaaagctggtccctgattacaaaggccctggagatgtggcccagagaaggtagaccttgaccatcctactgagtcttagcacagtccttccatgtgcagactgagaaggggagctcaatcccagagaggcccccactggcatgaaagaggtggcaaagtaagcaatgtgcccatgtgctctggtttatttctataatggtggttttcttttcacttaccatttgttcataaattgggaaatgggacaggcttgtatattctgagggggaatgggttgagaaaattagaacactaataacttgaggcctggtgactgtgcatgcagactgggagagctctcagaagcacttggtgggagttgagaaatgggagaatggaaaacactgatggactctgcccacttgtcgctttgctcagatataacgcttgcatacatcagtgctttgagaggaggacaaaaggtgccgggaacatggtcaacggattggccaacaatgctgaaattgatgacagcagcaactgcgacgcaactgtggtgctacttaagaaaggtaaccaaggagagcactttggggtccaaggcaggaggatcaattgaggccaggagttcaagaccagcctggccaacatggcaaatccccatctttactaaaaatacaacaaaattaaccaggagtggtggcccaagcctgtaatcccagctgcatgggaggccgaggcatgagaatcgcttgaacgcaggaggcagacgttgcagtgagccgagattgctctactgcactccagtcaggacaacagagccagaccctatttcaaaaaaaaataaaagaaagaaagaaaaggtaaccaaggagatattgtgtgtgagaagaaagtgctagaatatgagcccatctgcccactctcatagccacacatggcatgtcccagctggccttgagagggcactccctgccccgagagagcagaagtttccagtcctccaaccctccctttcactacaatgtcatggagccatctcatacctggtaagccccttagagctcagaaagccccctggaaattcccaggcaacacatttgctcgagtgctgcagagaacaggatggcaaaggaaaggagaccctaggttctgagatagggttttggttgtgtgaccatgaagcaggttatgtaacctcttgagcctcagttttctcttctgaaatacgagaatcatttttgtaataagcaaagtagataaatatgtgtcagagtttagtgcaatgctctataaatgacaggtgttattagtatattactagatccaaattcactttaaggctacattaactcagtttccaagctgcaaacagaaatagaaaagtgccttcctcttcaaagtaattcttgtattcagtcgagtcttacaaaacagctgagacactaagggaaattagatggtgctctcaaatatataatattttttctaagaggaactcagaaaataatcatttaattttacctggaatgtgttttttacttaattttttaaacttttctcttgaaatatgggagtttattttttcttggtcccatatggttgctttgcaggaagaaaaaaaaagaaattagaaagattattttcaaatacatctatgggttattttcaaatatatctctgacatcactgcatcattagattttcaaaattaaatatttgatatatttttctgaatgattatacatatgtttaacaaatgacttaggtgatttagtaccatttcacatgaggattttatttagtttcttctcttctgggtagtttataaccgtaaaaggaatatgctaaagagagctacctagtattagccagtgtttccagagatcacttcatgctttagtggcttggaaaacaggagctagtattacaagaggctgcagccaagtacccttgaactgtgtgcatatacagctcattcatagagagggagctggacccttcgtgcaacattattttttaggccttctggtgaactatcacacaagatttgtcccaagcactcttctgacctcggttctctgtaacatgaacaactcacccaacacttgtcagctctgctcatagactgggctgagggaatgtgtacatttcaccaccatgtcctccagtgcagaactgcactaacgtcaattcagtagcatttaacagctcagtatgaatattgctgacatttgaagggcatatagggtacaaagttcttggagtcttctctgtgccccagatctgaatggtgggaaaagaatcctttaaggacaaggaggaattctcttatggtatcattaattcttaccatgtcagtgaatgaggcttaaattgtttcaagtcctttcaaaagatttaacatgaacacccatggaaaggagattttgactcttgttcaaaatttgctcactgcaacccttcctggctggctggatgaatggaaagaaggaaggaaagaaggaataaggaaagaagagtggatggatggatggataggtgagttggatggatggaaagaagaatgaatgcatggatgggtggaaggaaggaagaaataaggaaagaagagtggatgagtggatagatggatgggtgaatggatgggaggaaagaagggaggaagagaaaagaagggaaggaagaataaatgaatgcctctttcctgctcctggcctccatgttattttaccttatgtttttcgtttccctagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgaggtacctgggaaagcactgtccactgcccactggacaggggtgggaaactctgggaaggagagaaggtttcttgtttgaaagaagaagcacctaactcaaagtttaacaccgcagcatccctcagccatttcctaatcttagttccctgggccagctgtatatctggcccttgctcttccctccacgtgttgagacatggactaatttccatttatatagaaaactcccctgttccttctccctttcacccacatttttcttctattcttccatttgaataaagccccctgatatgaacttgcacagaaattgtttctaactaagggttaccttagtttaaagtaatccagagtccctgacttgaattttgctgtgcattccttttctggaatatagccttattgatacactagaccaaacacagttgtgcagctttctcacatagggacccaggaactcctgcagtctggggaagaaagatgacatcacagtgcacagagtgtcaaggaactgcacatcccctaagaactttcctctaaagggatttgcaagttctgatgggtcataaaagactaatctttcctcccagatggaagttgtctggagttggttatcacattgagaggccccttaaaacttgactccagggtcttctggaagcatatcgtcagctgccagggaaagatcccaacagctcatgttctgagtgtaaggtatttgcaatccctctgaccgtggtaagagtgcgcctttctctttccagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctgtaagaggttctatgtctgggctggggttgggagctattttgagccactgagtagatgcccttgacttagattatctttttaccattcaattttttaaaatctctgtatgaacatgagactatgtatatcaagtctcctttgggcaggactttgttgtagaagttcaaagatggccaagatgggggtccatgatcattgcttgaaatgtgagctctttaaccaactctgttttgtggaagtgttactgaaatgtcagggatttgttctaggtcctgctcatcagtacacagaaagccagtcactgagacaacgaatattgccagggaagaaggctttaatcaggtgctgcagctgaggagataggagatcagtctcaaatccatctcgctgaccaactgcaattggggatttatatagcagggaaggaatgtagctaccttccagcaagcaggaattagggagaagtaaggaagaggaattgctccgcaggaaataggcagtccatcaggcatcacgatgaaggagagatctgactcctcattgtccagacacaatgatctggtgagtttcagttccttgatgccatctgggaggcctaagggtccatttcctgagaaaagagctcagggaagacaaatgtaagtttcgcaagttttaaagctgagagagagtcagtttttatattaattcaaaagaaactataagcatcagttctatgggacagttgggctggtttcaggggacggtcttatcttacttagctgttctgcaggaacttttggtatgaaggaagaaatgcccatgacccgtgtgggcaaggcagcttggtgcacaaaaggagaggcacgtcactcacctccacccatcccattgcacctagccgggagagctgtcctgccaaggccagcctggtggatgccaaggcctgaagaagctttcaggacctcagccaccagggtggtgtcctcctctcccaactgctgcctccaacaaggacttggttgttccagaaactgtttcaccccaccccacccattatcagagcaggtggtccaagcccaaagaattcagcctatttgctggaccttccagaagcttctggctgtttcagggaagagtacactagtttgattcacatggactgtcaagtgtgtgaggctcagtatacatgtgcagcaacctcttcgggatgtttgaatgtgcaggattatctgaagaaacgtttgattgacttgaaagcccatttaatgataggacatggtgccgagtgtcagagtcctgtgttaattttggatgcgcagggtcttgctgtgctccaggggagctcctttctgtccagaggacagcaagtaaaacttgaaccagagatgcccctgtgcccactcagggcacccaagatctcagcctcttcaagaacttatcagaaaatattcatccagattcctattcccccaggtcccttacctcccacccaaagctaaatcattacttgttagtacattatcttcatagaaaaaatgtacactcgttctttatccattttgccaccatcagatatatttcttggcaacctttcctatcaaccaagacaaaaacatcttaaggattaaatggcaaaacactcctttcctcccttgtaaacccttccattcattttctgttgctgcataacaaaatgccacatattttgcagctcaaaacaagaccctctgattagcttacagttctgtaggtcagaagtcctgctggattctgtctcacaggccgtaatgaaggtgtagccagggctacattcctttgcagaggctctgggagaaatcattaccaggcaccggttcattgcggctgtgcaggtccttgatggctgtcagctggggatgtcccactgttcctaaaagccacagagcccctccaccttcacctggatgtgtggagctcttcccgccatcattcctaatctctctggctccccttttgcttttgaggactctttgcagctagatcaggcacctgcacaatctctctacctaaaggtcaactgtgccatacaacacagcagaatcacgaggctgatagctcatcccactcacagaccctgagaatcttagggacctgtgtctagaattccacttactcaacccctgttttcagagtccgccattagctggccataaccaagctccagtaatgcttatttcgctaaaatctttcactaattaaacagtcgagccagtggaagttctgtaagtgaccaagttctatgttagcatcttgggagcccagaatccccaagtgcacccctccaggggacaatgaaagatgtgtgtgtgagatgagaccaagtctggcccagtgcctgggcctcgttactgattgggaccaagcacccctttcagatccctggttccgtatttctctcctggatgagagctaactgtggggtttcaaggtctttgaaactcgtgctcgccaccctctgtctcactgtgattaggttgcagatgatggaggcctcagaccttccagccacaccttctgggctcctgtgtatgaggagacatggctgcaggcatctcacccccaacagatgcttcacctgaggctcaggaaccccacatcccctcctgtgtccttcctgaagcacagacaggagagaagagacgatactctgtgtggtcgtaccatcccgtggggtctccatgtcattcaagggctcccagctgccaagatagaaagcagaattccaagttcttctctagcagcccttctcaccagggcttccttaatgaaatgcacgttctgattcaggaggtctagggtgaggcccgagtctgcattgctaatcaagaaccggctgccccccatcctgtgacactgacgctgctggtctgtgtgccacacttggagcacggagaggctagagacctagaggcactcagcaatcttcccagttcttctaagatgcgggaaagcctgattcagagcccgggtctgcctttgaaaagagtgggctcccccagttacaactgtctcttcccctccaccagctgctaaggaatcccaggcccagaattaggaactccattttaaggcaaggggactgaatgtccagccaggcccgcttcctggggcaggcaggcctctgcttatgggtgagaagcctgtcgggtgcttccggccagcagagggcattgagaagccagggagtcagttctgggagccccagatgggttcctatcaagtcaagttcctgtggactgaaaaagatccgtccacatgatgaggacatttttctctctcatagtcattctgcaaggcatgagtaccctgtttctggcacccagccacagtgctttcttctctcaggacttgactataatgggtatgatgattaccaagaaagtaattatttaggagtatgtgaatactgttgtgagttcatatatgtacatatatgtacagtgtgcaatttaagattgatataacatagtgttaacatgcacatgtatactgtgtacacttaatatattgtatgcatgtataatatatgtgcagatattaacatatttatgtttatatatgtatatactatattataggttatatacacacaatatacacatatacatctacacttggtatatgcacatacatacatataaacgtgcagctattgttatctcttgggtgaagaaagccttattgttgacagacagcaaaagaaaccttttcatgtgtatgtaggtaaacacatttccatgggaaagaaaaactagaaggaaatacaccaaaatataagtaggtttttccaaagcaaaattatgttttttctgtattttttactttaaaacagtgtacatttttattgccgatattatcggaacaaatgtatatgtttaggtctaggtctaaaatactgtgcaataactttttctctctttgatagaattcagctttcttcaaagctgactgaggaacataatttagaaacaaatccttttgcttgttaaagccaagtccaactcaaagggatactatcatgcttacgggccagctccggcccctggcttcagctctcagttgctggctgacttttgtgaaatcaggtaatcaccaacacatcaggtccatggtcagggaagttttttctcttaattcattgctgtacccccaggacctgcagcagtgcctggcacaaaatggcatagaggacattcacagatatttattaaatgaatgaatgaagaataaacctatcccccttgttgctctattttgacccaatggtaatagagcagaagatggaaaaatgtccagaaatgttgttgactcaaagaggaaaggaaacctttttaaaccctttattcagaaatggaaattaagggctgggcgtggtggctcatgcctgtaatcccagaactttgggatgcaaagggaggatgcggatcacctgagttcaggagttggagaccagcctggccaacatggcaaaaccccatctctactaaaaatacaaaagttagccaggcatggtggcacacgcctgtaatcctagctactcaggaggctgaggcaggagaatcacttgaacctgggaggcaaaggttgcagtgagctgagattgcaccactgcactccagcctggacaaaagagtgagactctgtctcaaaaaaaaaaaaaaaaaaaaaggaaaattaagaccagctaaaatgtgggtgatctttatttgactgcctttgttcctcaaaatcatttttaaaaaacacctttatatttgttatatttgctgcattacatttaaatatatgattcagataatgctcattgaatttctgcttttaaggttctgttgttacaaaggggcaataacttaaagaaagcatatatgtcattgaaaatgatgttttccagatataatgccctcccagtgtccagtcagaaatttttaaagcagttgataaaaactcaaaattcactggcactaacttacacttcttacaactttgtctaatcaatatcattttccaagctcttgcactcgtaaattctgacttcatttttttcttccctctttttttttattttctgaagaatgtgaaagagccaagttgggatcatttctcttcctcttcctgtgtttcttcgtaatctttgattgggtgtgtattttaaactaaaccgagttactctgtccgtttgagggcatcagccatatggaaggccgttgaggggattctaggaggttccacatgggtaaatgccttatcagcacattgcgggatttaggaatgtgccaaattccaggatgcatttgggatccaaagagctggccatatcctggattctgcagcatctggaagcccctctccaaacaactctcagccaggcttcttgatttacaaagcaagcacagtctctatgttctcatcattcacttgaccatctccaaagcttaaatctaacaagactcatagcagctaataggaaaacacttctcttttcttactattttttttgtttgtttgctttactctgtacttgtaaattggatagccttagattctcaaaaccaagtaattttctttggtctgtctgattagattgttcataataacattattactactactgttactgatatttactgaaaatgcaatataagccctgcactatccctgcctttcaatcaggtgctaaacaagtgagaagacccctgttctcatagactttattctaatttgagggagactgaaaataaattaagaaacaaccctgatggtttaagacaggaaatattcgcatgaaacaaataaaaatatttgctatgaaacaaatagaaaagctggagtgagatgatgagagttatatttagatttatctgagggctcagtgacattcgagcagtgaagtggcctgcgtgacagggcagattctgccatgagaagatccaggcagaagacctgcgagggcaaagtccttgaggcaggaaaaggcttggagtgtctgaggacagaaagttagccaagaccagggagtatgtgagcagggagagtggcaggtgcggcaaaatcaggcagtgccttacagaccatggtggggagacctgattttactctaagggcagtggaggccagtggaaggttctagaacaatttggtttttgagactctttcctctggctactggtagcaaacagatggaggtaggataggcattggagcagtagtccccgtaggaagccaggttgtcagccaggccttggtgaacctggccccagcggaggctgtggggatgatgagatggtgggaatgtcctgtcaggttgccagggttggctgtgggggataaaagaaagggaaagatcaagaatgactcccaggattttgacaggaacgacttgtgagctcatgttgtcccagccctcatcctaatatcatctcatttaattctcccagcaactctgtgagctcggtgctgctgtatacacattttcacagatgaagaaactgaggtgtagagagtttaattaactgagtctttcaactcataagccacagagcagggaccggagcccagcaccatctaatgagaaacccctctgcctcccatagacactgtgcctcggccctttaagagaggccagagggtgccagaaataatgttagatactttttctatctatgcagttttaagaaactatttggagattggtaggatatatgaaacaaatactggatactggtctaaaattataaaatacattttattaaacatttaattactgttcaaatgttataatataaaaattcctccttaactctggtgggaatataaaatggttcaatcattttggaaaactggcagtttcttataaagttaaataaatacccaccttatgactcagcaattttcctgggtcttcgtccaagagagatgaaacatgaccacaaaaagacttgtacaacaatgttcatagtcacctggcttgtaataccctcaaactggcaacaaacaaatgctcacccaccgccatatggataacaaatcgtagcacattcataggagggaatactacacagcaattaaaaggaatggatcacgcaacatgaatgaatctcaatcacattatgttgaaaagaagaaggaaggcacgaaaacatcctatatggttttatttgaagttggagaacagtaaaaacaatatctatggtggtagagggtgagggtttgactagaaagaggcacagcaaactttctggaaggtagaggcactgtgtatctggattgcattgaggaatacatggaaatatgtatgcatatttatttctagaggtgaattagcagttaatcaggttagtaatacaggtctagggagagccttcaaatcctctttgaagattccggcgcgctgaccgacgatgctgagaaattccaccaggtggcgctgcgtccgctgacgctttattatcgggcgaaaacgtggaaaacagaagcccactggaggtcttcctagctccccacccccatttcgaccccctgcacctacacacattccacctcttttttgacctgagtatcctcctctcttttcccacctggccatctgccaaaccatccccctagcctggtattactaagaagtgattcaccctctcatttcggagacctaatcagcaggtgggcagtgggtaattttttttttaattctgtttggtgttgcatgtcaggtttcgttggtgatggaaagtcatttgaatgttttagaaaaagagcaatataataaggtttaattctggggaaagcagtacagacacttggcagagcaaagaaataaagctaactggggttctttgttattttttttttatttctttttggcctttttcatttttccagcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtgagtgcaatcgggaccccatggcactgttaaatctctttagagaataaagaagggaataagagtcagggtttcagccgataactgtactagtcagctattgctacaataagctgcacaacgaaccactcctaaacttagtagtttagaattgcaggcatcgattctcctgctcacacgtcttcatgttgactgtggattcattaatcttagctgggacctgctatgcagctctgcttcaggcttcagggtggtcatgtttgattcaggcagcaggtggggtccatgtctactccacgtgtctgctcattttctttgtaccagaggctagctacctggggtatgctcttctcacagtgcatcattagaatgcaagagagtacgtggaaacacgaaatgcctccaggatcttcgcctggccctgacttaccatcacgtccacacacattttactggccaagccccacatcaatggcatgggggaagtgtactccacctgctccagtgggaagaacagccatgtcacagggcaaaggacatggaggaaaggcacaaagaattgggaaatgatgatcaatccctatcggcatcttagtttcttcagccagacaatgaggcattgtatgaggtgatcactcaagggtcccttctgaggctaaaataatgactcagtgattcacattggttgattgacattgactgatattagttgattgacatcgattcagtggctttgaccttaacaaagccattttaggaaacccagccttccagaatgcattacccatttatggctatactttttaactggggagaaattccaaatcattaggattggacagaaattaaaaagcatggcaaaatgatgcaaatccaaattaatcttgccttgagtgttggatagaaatgtaatataaattctggagaattaaactcaagagctaaaaagaaggttatgaaaaagatattttggtaagaacaaaaatacccagaaaaattttgctacatgggttgcaaatttgtaaacctgacacaactaattcataatcatctctttcctcaatatcacaaacatttttttaaaacccaagttttatagccaggggtttctccctcatcctgcattcactaatgttttcatctgacatatgcaccaagagccacctcctatctggatttgggggacagtgttggctgtccctgaccttaaggtgctacatgattttctgtgcagccccctaaccagcgggctaactgacctgactcatctgaggttcaacttccttctgtttgcttccttttcctccagtggaggttctaataagtcccaatcaatgcccaggagtagggagaaaactaggagaagccggagacctggtcccagccacctgagcagtctgctcccctgaactccagacccagccacaaacatgatcatgaaaatgatgaaccagaggccaagactggctgagccaaaccaggttcctacagggactgagctgagggttaaaaaggaaaaacaaggtttggccaggacgctggtagctccatttgatccagagcgacaaaatagaaacagcgtgtgtttctgcagctcactttcctccctggagaccggaagtcagaaagccctgtggccaccccaggttaaattctgttcagttctgctcagtactgaacagaaatgagctgcattctctgtctgaaaggaggcaaggcaagcatctctatggatttcactcacatccccccaatctttgaacagggaaggagcgattgtggcctttggagtgaagtcagggttccgggtgtaggtgtctctcaagggctggcccaggaggaactgtgagaagaatgtgctccttacaacatgtgctttgcatttcctgtaattttatggcaagtgagggagatccagtggcatcctaaaatgacctgacagtttcaactcttgtgagttatcttctccttgggcccacatgcagggaatgtgtctctttttccacttacctctttttttgccaccagctccctcatcatctgcctcatcaactgcttttgtttttttaagcatgcttgcatttgctttttctatatttgcataaatttaagcggtacaagtaaatttgttacatggatatattgtgtgatggaagtgacgaagtcctgactttagtgtatccatgactgaaataatgttcatcgtacccattaagtaatttctcgtcacccaccccacttcattccgtgctgaatttaaactgaggtggcctctggccttcctgtttttcagtctccagggaggaaattgagatgtagaaacacaacatttctgcccccaatccttccaagactccattgcctatcattccacaccccatgtccaagtgtacacattacgtagcacccacttatgagtgagaacatgtggagtttgactttctgtgtctgagctgtttcacttaagatgatggtccccagaagctattatagtgaagaagatgttgacaaggacagcaaattgctaccaagcttcaaggaatagagaaaaggaaatgctagttatggctttcccctttttttccttttcttttttttttttttttttgtgagacagggtctcactgtgttgccgaggctggagtacaatggcactatcacagctcatcgcagcctgaacctcctgggctcaagccatcctcctgcctcagcctctcaaggagctgggaccacagacatacaccaccatgcccagctaatttttaaaattttttgtggagacaaggtctcactatgttgctcacgctggtctagaacttttgaacttaagcaatcctctcaacttggcctcccagagtgataggattacaggcctgagccaccgtgcccaaccttagagttatgccttttctaacaagtatggatactgtcaaatccagcccctttgcagttcttctaaattcccattgtgcatcctccctgacatggacgctcaaattccaagcaaagcatccatccattctggatgcctcagggccacccgtagttcaaatattctgtcccaatattgcctttttcccagaaattctattttctcttctcaaaccacccgcctcaccggaagagaacaagtgaaaaggccaatgttttgttggaaagtttgggtcctattacagcaccgtcccctgacctgcagccccggtcggcatccacatagtgtttgtcaccctctgtattgatacagagagcagacattgcaccccacagagatagcccagaccatagcctgttgtgagtctccatcagaagaatcatgggcaggtggggcttgaggtgaccctcagctgaccacctcttcctgctccttctaggtcacaatcattggttacaccctggggattcctgacgtcatcatggggatcaccttcctggctgctgggaccagcgtgcctgactgcatggccagcctcattgtggccagacaaggtgggacttccagtggcaatggggaaggagggagggagggaggaggagagggagggaagaagggagggagggagggagggaaggaaggcaggagggagaagagaaagggagggagaagagaaggaaagagggagggagggagtgaaggaaagaaggaaggaagggaggaagtcaggcgggcaggcgggcctctctacctgggggacccacctggtaattaacagggtttggaaggagggagggtgatgccgtgttggttgaaaggtttcctgggctcagaagaacagagaaataatccagaaggtcctacccttgaggaaagcaaagacatttcctaggtagcacccatagccccttctggaggctgtatcaccatcctcctattattcaaagtagtaggaaatgtactgacagctaacctttactgagtaaaacatgatagatgcactatcttatttgatttaaacaacagctctgtgaaataagcacaatcatacccccattttatggacaagaaaattgaggcttagagaggacaaacctcatccctaaggctgacccacctgcagtgccctctaagtgacaggtcccagaggtcagttttcagagtgtgacagatccttccctccttcaaagccaagctcacaggctcacagcttaccttcccaaacagattccccagatggccacacccttctgtagcactcattctgacgcatctgcctgatttatgctggagggcatttgtttcaaacaaatgtgtgttgagctacaaaacttagctcagtgtcccatagacatcctcatgaagctctactgttgtctacactattgttcagttattccgaagaaggactggagacagtacagggcagttggaagatgacccagtatgcaggtgtgagctcgggagtcactttctagaatggttgagtttattcctttccataagggtgtctcagaatctccagaatccttgaaaccatctgtattagtgcgtctcacattgctgtaaagaaatacctgaggctgagtaatttatcaaaaaagagctctaactggctgatggttctgcaggctgtacaagaagcatgccagcatctgctcggcttctggggaggcctcaggaaacttccagtcatggtggaaggtgaacggggagcaggcatgtcttacacagcaggagcaagagggtggggggaggtgctacacatgtttaaataaccagatctcacgagatctcactcactatcacaaagccggtaccaatgggggatggtgttaaaccattcataagaaaccacccccataatccaatcacttcccgccaagcctcacctccaacactggggactacaatccacatgagattttgtggggacacagacacaaagcctatcactgtatttggttttttgaatcacttatattcaatcagtgatgatatttgaagtaaaggtcaaccattcaatagaacgtgtgtttctctgttttataattcatgtcatcctttcacatgggtgatggccttgaaagagaagcacatatgtgagcttgcagaaccactctctggctgtgagactaaaggcttgggagagtcctgtgtggggcccctgggttcccttccctctcttaagtgacctcttgtccctgcagggatgggggacatggctgtgtccaactccattgggagcaacgtgtttgacatcctgattggcctcggtctcccctgggctctgcagaccctggctgtggattacggatcctacgtaagtggttttctccaggacttctcctgaaatccagggctacgtgactgtgttttaacagccttggccacagggtctttgtctcggggaaaaaggggtgtagaaatcgtaatattgagggggaaacaaattctccttgtcaaaggccttactagtcaggcttgcagggacattcaggactttagagcaggggccagcaaactttttctgtcgaggggcaaatactaaatattttaggctttgtgggccagaggatgtttatacagctattcagctttgctgctgtagcagaaaaacggccatagacaataaataaccaaacgggcatgtctgtttcaatacaactttcctaacagaaaccgaagtttgaattttatatcatttttatatgtcatgatatataacacttcttttgatttttgttccaaccatttaaatatgtaaaaaccattcttcactcatggactatgcagaaacaattggtgggccaaatttggcccatgggtcataacttgccaacccctactttagtgtacttagacttgcttcaccttattacaggctaagtgattcatgtcagagaaacactggagagatgccatccaggctggccactgaaagggcaacgccctggcggggagagggggagagggtcacagaattccaaataactcttctaagttctgcagcccacagggtgagacttttgcagtcaggctcttatgaattgactcacatcagccaaattcacaagaatttgatgtctaggatagaatgtcaacagatggtagtaacagatggtaagatatataagggctgtgcagaaagcatgtgcttattttggatgatatgttctctatattcctggagaaatatcttatgtgggaattattttgggcatcctatgaccatcctctaattcagggtttcaggagtactcacagattacattcatggctaaggtttattatagcacaggatatgggataaaaggagctggaaaatgaaatgcatcaggagaagcccagcgtggtcagctgcaggcctctaattccttccctaatgagtcacacaggaagtgctttctcccttgcaggaaacatgcatgagatgtctctatccagggaagtccactggaggctgaggcttttggggagggctggtcaagtaggcacattcctgctgcatgaacagccatgatgcctgaatctcagaaccccagcatagataccaggtagacattataaagtttgggaaatgatcgtgacaaattggtacagcatggcctatcgcttctggggtacaaaccaatgtcatcaattgtagcatcccaagggtcacattcacaggggttggccaaaggtcaaccatggttcaggactctcctggaggtatgcaaggattaaataaccaggcctgctgtgtcaacaactttcgcagagaaggtcaaattatggttttatttttcagaataagtgttgctagctactgtattaccaaaaaccccaaaattccactggagtagcccaacacgggattggttttttactcaaattccactgcagatgttcccatcctggcagctctcatgtctcttccaagcagaaactcagggtttgtggcacagtccatccagtggttctaccatcttgaagtccttctcccatagctacacagaaagcagagaaggcaagggcatggaatattgtgtagatcactttctgatgaggcctggaagtggtgtctgtcccaactgttcccatcccactgtccacataagttacatgtacccacttggatgcaagaaggatccaggtaattaggttagtgttgtgcctgaaattcatatagccacatgtggcttgtggctgactgttggaccctgtagctctagaggattaaatgacaatcacccagagtctaatccatagataactattgttaacatttcagcatatttttctttctctaggttactttgtatagcaaagatcatcctatgtaggcaattttatacattgctttttatacttcctgttatatcaaacgttttttcctcaaaatctcattggaaacatcatcttcaaggtgacctattattacagtatattccaaagtgtacttaatcatgctgctgctcttggacacttatgttgattcaaacctttcactgttgtaagtagtgacaccacagacatctttgtacattaacctataggttttagagttttacctaaatctatacttttcaagttaacatttcaagttcttctttagatgatttttctcagtgttagaaaagttatataaaagattgttttccagaatgacaatattttttacatggttatttgtccagattcattcctgaagttttgggacagctttatgacaccctcatatcctgaccacaggaagccccatgagggctgacattgagcctttcacatgtctgtcttcttcatggcacacagtatggggcaggcacatactcaagccatgaaaagcatgttgaataaatgggaatccatgtttagctcttccatggcctttgcattcactttcaccagcagtgaaagttacctttcatgaattagagggacacttcaggtccaggctgagacacgagggcatgaataacctcgtaatttggtgccccccgaaacatatttttattaaaaaaaaacattaattcagcatttattttcaagatgagataaatgcttcatgagcaaagggtggagatgggagattactggttccttcagtaatgcagtcttctcttgttatcaagaagttcagctctgaactcaaacttgcatatcatggtctgaacaaaagcttcgcagttaacacaacctaacttccttaaaaaatatttagtggctttctgtctctactcagtcatacgtgacaaggatgccaatgaagatactcctcagcccaactcagagtgctgcatgcaggggtctgatgaacccgttggcagtccatctggtttactcctcagcttgtttcacttccccattgacctcttatcaaagttatgaggaattaaaaatcagaactatctgaattttaactgctttttgtccctctgttgaggactagaagacaatggctaaaaaacagacatcaaaaagaagaagaaaaaaaaacctgggctctaaacaacctgaagaattcatccctgaataatatattttcaccaggatgactctccagtgagggagggacaggcaggagcagagaatgagaaactttcaatgtccttcagatccatgatgttatttcttattttactttgattaaaggggacaatcatagaaggtgaaatcaaaaactttcaaaacaaaactaaaactcaccccagaagcaaaccagtttatcttactaactttgaaatcttcctgactagacatggatatcaggcctgaaattccaactcgattcagcacaccataaatcattctcctaatgatctctcctcctttcctccccttctgacattttcccaatactctttagagaacaaaaaaaattaaacattattcttctatcagtaattcccagagctatgaaagtatactctttccagatctcaatgtctactgacacggtgacatcatgaaaacaaaaattcaggctttagtggatgtttggtccaaattcatgtttttcacctgaagatgacataattggatcactctggtcattctgctggaattatacaagggccacattaagtcttgaaattgaagatctactttatccttgaagtcaagggggaaatgcaggagaagaaaccactctggcttattatgatcaatagccatgacatgcacaagagtcctcttgggggagacttggttaggaagactttggagaaaggtgtgtcatgttgtgtttccatccaaatgctgctgtttctgtaataagtgcaaaaaaaaaaaaaatcattttatgctggggatacaaacatccaatgcagaccactcttttgaaagtagaaaatcagtaatataatcaataaacagtttatgaactccagggaagtcaaggagattccatttgatatatggtgtgaggtagggattcaattttattatttggcacatagatatatagttgtttcagcaccgtctgttgaaaaggagatttcattttgagctttaaaaattcaatggaaaaatttctggttagcttatttttcagtaataatcacaacctaggaactactaggaagccatgatttggttaaagctgtgaatgttgcatttcataagtaatgctaacttccactatttggaaaagtttatcttgagtcaagactaaaatgtaaatgaacaagaaacagggaaggatcaacctggtgaactgaatcggggagtgagggtcataaaatcagccccagatcctagtggcatgctttaatattctgcattctccttattctactcaagtagttgctctccttccttgagagggcatttaataagggaagaatccctatgaagagaagaaccccaaatgctccccacatcctaaatcttctaatccttctaagctctgcccaaatacatcctcacactgcacataatctctttccacatccctgctggcccatccacgttcttccttgtttcacagttattaaccacatctctctctgctgttagaatctgagtttaagacctcatccacttaatgtctgccactcacactgcaccagtatccatctgacacatagaaggacattttatttgtttaaatagagaataaattttattttttcaactgcagcagcaagcaatccctttgtacatcaataactcctgagatctttgccatgtgtcagcccagttaaataatttatattaatggtggtgatcctgagtcattcaagaaaaagttaagttagatctcatatcctctaggataagcatcaagtgtatgatctatttcaaagtgaaatatttcatcaaaaatagttaaggaactagcctatagaaaggtagactttaattttccagaagcttttgcttgtacagactatgcttctttgactaataatgttagatcaaaatagtaacagtatttggcccaaccaaacaatgccttttggtttgcttggaagctggggttcccagaaaatggcactctgaacccagactacctcacagagggggttacaggggccccaaccaagggcttctttctttctctagctcatccttcaggtatcaatatagatgttgaactgggatttcccaagcctggaccagatgtcatgcctgtgttcagcagttctcatcaaagtgcttacctttaccccttggtctgagtctccccctggagaagtgacctccctgaagacaggaactgtgctcctctatgcatttattattttgtttgtgcctagcgcagtgcttggcacttggaacatattccacaaatatttgttggatggatggatggatggatggagagatggatggatggatggagagatggatggatggatagatggatggaggaacatgtgtgagcaaagaagaacagagcagtagggtgacttgagaagagagtaggggggcaagcacaacagcaaaaagaatagctagaattcactgagcatctactctgcaccaggcactgtaggaacactgtattcgcatggtctcatctaatccttccaacgcctatgtaagggaatgattattctttcaaccagggcttattatgcacccactatatgccaggaacttgtcaaggcaatagggattcagaagtgaacaaggtagacaagacctttcctcttagagtatacattgagtggggaaggatagacagtacatacgtgaacaaatgcctgattgcactaacttcagaggacatctgccttatgcagatgatgagttgaagtgatgttttagagagagaggtgcagatgtcactctgtatttactgaacaggagattaagttctgtgtggagtcatgagtgacaagagccagccatgggaagagaggggtgtgtggcgagcaggggagcattctgagaaggaacagtacttgcaaaggcgtcgaggcaggatgtgtcctagaacaggagacatgctgggcagaggtagtgcagagtaaggtgggcaggggtcacactgggccaccaagactggtcacagggctcaggtttcatgctaaatccaatatagttcttagctcagttctgcagattaggaaaccaaggcacagcggttaaatcacacagccagaaagaggcagagaggagtgctttcctcaaagcactgacaactattgccaaagcaaatcatgccacagcagtcacccatgcataactctgggctcagaggagaaatttcagaccagatccatccctgagtttgaatctttgctaaaagacagggcagggtctgcttattaatgcttaggtggcttcttcaactttatataaagaagtgaagagctagaaggggaggaaattctgatccccagttttctatcctaaaagtaccaacaggcataatgggggctgcactccttgctgtcctgggccatggtaactgatatttctacagggattttctgtctgatggttggaggaacctctctggatcctttgttcagtccctggtccctccctggctctctttgggtgtcttcaagtggtcgattcctcatgctcagccacactgggcagggtgggggacatcaccatggagctcatgccgaaatgcagacgttatttggaaaaataatcccaggttcatgaaaaagcaaatctagggcttatttgcttgagagcattttgatctgccctcttctccaccacaagcttttcctatgagaggctttatttccaaaacgacactcaaaagcctctttcatgtagcatggtagtgaccgcatgacatctttctgcatctctgacatcagaaccgagcagctactgtgggtttaatggccctcctaacctcacaagggacctgccaacaattttgagcaattttttcatctcatctagatgggatttccaagtcataattatctgataattaccatccggatggctgttttgtgcatggcattaggtttaagcatttggcagggaaggatgaatgcagttttacagattttgacatttcttaatactctgtggcttgctcagaaggcagctagttacctaagtgcccaaaataagaaatctttctaaaagtcaaagtttggaaaatgagcacttcttgttccattatggtgatgaacgtctgttccacaagctttaagagagctgagaaagtcaccatgcaggctccaggaagccagggcaaaactcatatttctagctagggcttagaaatgtaaaataaatctgagatgcaatggagggagggtgtctgtctctctctctccaagcaagagaccaccagagtccagaaacaacagagacaaaaagaagagctgtccagaaatattctcaccccacactgtctgcctggtttattctttctttgacaaagtgttaattgagtgcctactatgtgctatgctggtaaccactggagatggtgcagtaagcaagacagtcagaggcctatgctcctggacctacagctatggaaggagagatttgcacaagcaattccaaaacaagacgtgatgcctgctctcctaagggctgcctatacagaagtttaggtagtgtgtggcagtgattgggggatctggaatgctggggaggaaatgacagttattctgagaatccaagattatcaggacaagcaggtggagagaggtgagaaaatttatttccaaacagaaataagagcttgtagaataccaagatatgggaaaacttgttgcactgaagcacccaagggctgcttctgtggctggggggagtatgggaggggtgaggagttggggaactgaaacaaagtggcagaaatgaaactagagacagagaagctgcatggtaaaggccatggtaatggaaagaataaagggtacatgagaaggagaggtacggtcatgtgtgccttttagaaaggacgttctgacaattccgtagagaaagcactggagcctgacaagactgatggcaacaagttcagctacggggcatttgcaggagagagagaatagggtgattggattaggatggttgtatctgttagctatggttaccctaatgctaagtaacaaaaggcatgcatccattagcgtatatatctcagtcatacctttgtggctgacaagtgtgtggctgctctgggcttggctgcaggcttcatatgagtctgctccatgtgcctctcattctctttggaccactggcttctcaagacacagtcttctcatgatgtgtctcaaagaagacacatcatgttttgctcttctcaaagcaagagcacaagaagacgcacccagcttcggaaacacattatggattcaggctcatatcaggtcagctaacaccattggccaaagagtatcacacagccaagccccaaatcaggaagcagaaaaatgcatccacccaccatgaggctatggaaagtgtgtggacataaaacctattacagggagaggaggtgagaccagcagttcactctgcctccacagtagcggtaaaactggagatcagtggaaagctaagcaagagactacagaaaaaaataacaggacctggcaattagtttaactttagcccctaaacagctgttcatgcggaagtaagtcgggaaaggcaaggattttgtaagctattgcaaacttttcaggtgttattataactacgattgaggattttagcaaggcaatggcatgattcactttacattttaagattacactggatgctctttctaaatgcataggaggcaagagtggatgaggggagacaggtcaaggagctgatgacaaaaagagattctttttaaggaagaattaataagattttctgacagttgtatggagagaatgagaaggagaataatcataagtaacatgtgattctttgcttgggcaactaagtgtattgtgatgccattcatggagatggggagacaagctgggagatgaggaacacatttaagatgacataccaaatgttccatttaggacaaataaagtttgatatgtttgcgggtcacctgaatggagatattaagtaggtagtggaaatgataggtctgaagttcagaggcaaggtcttggttgcagatatgaattcgggagtcaagagcattaactgcaagtaacaacgtaagaaggtaagtgtagatagaggagagggcctagaacatgtcgtgatgttggatgggggaagaaacaaacattcactgaaggagactgaggaagggccagccagggacagggagaatcagaagaaagggggccacacagccagaagaaagttacaaggatgttggagcagccaagtatatcagaccttgtccaaggtccttcttctaaggccagcgctttcaaccaaccatcacctcctccaagaagcctaccctcagccaaatttagtacctgtatgacagcatgggggtatattctatgatgtgtatgcctcccccttaactccctgagggcagaaactgtatcttactcaacttgtgctccttaacacctagcagagggctttctgtggaatgaatcaatgaacccatcagttcttgatgtctcccacgtctttcattctcaccttgtatggcaaccattccgaattcaggctcccagcaccaggacactgctccctctgctagaaccagtcttcccttttctgcaaattccttcccacgcccccagggacagtagggtgctggagccaactcatatagcctccagagaagctatcatgtgcagctcttcatagcttcctctggcgatgccacgttggtagcttgaaatcagccatgatggcagtatttacaccacggaaacaggaccgtgtcagaagaccactgctagggtctcctacaaactatccccacaggacctagataggtaacttggggataatgtggtgatgtcttaatgaacgaggcttctcaaggttattcaaacagagctcctgggagcaaaagtatcaccacccaatccccttgatcttgaccattgtgtttcaggctctatgttaggaaaattaggtgatgcctgagggaaggaagggttcttccagatcctactgtggaagggcttacctggaaagctgaatcagtctctctgttcatcacagtttaggtccctcagaaactattcatttctaagaggaggatccagggtgaagagtttattgagggggagcagtatgagagtggagaggaagaaggagggaaggcagcccacagcggctgtgctagcaagactattaccacagtgggcaatcagggctgactcccatagtgggagctctgggaaacagaggacagcctctgtctcagaatgactccatccgaggggcaagggagctggggggtttattcacccactcctcagagtcactggtggagaacagcttctagaattgttcatttcttggcacttctttggtttaggagaaagtcctaaggcaacgaggcaggaatggctgttgggaggcagctggcacccaccaaaatagcacctcagggagatggggggatgtgggtgagtactgctggcagctgctgcaggggcatctgtgattcttaaagttcattcaggactcttacaaacatggtaggcagacatggtgaaaccctgtccctactaaaaacacaaaaattagccgagcgtggtggcacacacctatagtcccagctactcgggaggctgaggcaggagaatcacttgaacccaggaggtggaagtcgcagtgaactgagatcatgccactgcactccagcctgggtgacacagcaagactccatctcagaaaaaaaaagtgctaggcaggaaaggtccagatgcacttctgagggttcttagagggtaaagggaggctttaccctggctttctgctgtgcctggcagagtacaacaaaaagtgagaatttagggtccaaagtccaactctaaatgcagacctgacccctcaccagcttcgtaaacttgactaagtggtttaacctctctgagcctcagttgtctcatctttcaaatggggagaacaaaacccactttgcatatttcatgagtggccaccagaactaaatgcactattgtactaaatgactaaaggacttagggatgcaactgtcattaaattgcttcttttctgtgggctgggtcactgtcttacctcatttaattgttcaaacaaagagattgccacccagtgatattttacaatgtaaagccacagctgggaacatccatttggaaactacacccaaacaagtgtaaaactacccaaataagaaaatgtgaaatgacatgccacatatgttccaagttagaaataaattagcaaaaatccaggggcttcttatttttcctaaaggaatttgttggttgggtcaagctgaccacaaactagagagagattttaaactgtagtattagggaaatcagaatcttttagggtgggggtgttggctctccaaaggtaatagggttcaaagaactgttttatgagcagcaagtatgcatgaaacttggtatgaatgagtatctgtgtctgcatccgtactaaaaaatatacatgcactgtgggctaaatccctgttgactttggaactagccaccctcctgtttcctccacaacaactgccaagagggaattagagaatgaaaatgcatgcttcttaaggcaagaaatgaaaacagcattaaatgtcaggactgaacaatctgagatgtgcctcacatgctctcagatcagcattgccttgaagattttctgcattggcacttaatgttccttgcgtctttgaggcagggaggagggagatgatctagttcaacactgtgcaggcctgtccaaaggtcattcacggatgagaagggtttggtgatatcatttggcttagcatgcctcaagaaagtgttttactgccttcagggaaagttactgggatgatgaaaatgttttttatttttgttgaagtgtggattacatgagtataggtatttgtcaaaactcatccagtagtaagaacacttaagatctgtgcattttactctatgcaaattatgcctcaattaaaaagcaatttggttccctcttgctttgttacttgcggagatcggcttaaagccaaccctcaccatggcctgtctcccaatcaactctccactcttgccctttgctatgcagtctcactgcctcccagtatgcacatgcagtctcactgcctcccagtatgcacatgcatgcacacatgcagacacacacagacaaaggcacataaacacatgcacacaggcagacacatgcaggcaaacacacacacacacatccacacatgcaaacatgcaggcaaacgtacacacacacgcatccacacatgcaaacatgcaggcaaacgcacacacacatgcagacacacgcaggcaaatgtgcacacacacatgcacacatgcaaacatatgcatgcaaacacgcacacacatgcacacatacaaacgcacacacatgcatgcacacgtgcaaacataccacacacatgcatgcacacatgcaagcaaacgcacacatatccacacatgcaaacacacaggcaaatgcacacacacatgcaaacacatgcaggcaaacgcgtgcacacacacacatgcacaaatgcaaacacatgcaggcaaatgcacacacgtgcatgcaaacatgcaggcaaacacacacatgcatgcaaacatgcaaacatgcaggcaaacgcacacacgtgcatgctcacatgcaaacacatgcacacaaacacacacacccatgctcagaatcaccagcagatgcttttttcttttttttttttcgacaagagtttcactctgtcgccaggctggagtgcagtggcttgatctcagctcactgcaacctccgcttccaaggttcaagcaattctcctgcttcagcctcccaagtagctggaactacaggtacgcatcgccatgcccagctaatttttgtgttttgagtagagacaggttttcaccatgttggccaggatggtcttgatctcttgacctcgtgatctgcccgctttggcctcccaaagtgctagggttacaggtgtgagctaccgcgcctggccgcagatgctcattttgtttgtttgtttggggtagggttttgctctgccacccaggctggagtgcagtggtgggatcacagctcactgtagcctcgaccttcccagctcaagtgatcctcccacctcaccctttcaagtagctgggactatagagacactccaacagaactggctaatttttatttttattttttgtagagttgaggtctcactatgttgcccaggctggtctttaactcctagattcaggcaacccacctacatcaccttcccaaagtgctagaattgcaggcataagtcaccacgcctggcccagatgctcatttaaacatacagtatgtggagccagggactggaggggtgagggaattaggtgctagagtgaggaaaaactcacgagccaggcatctgccctctgagcatttggacctgctgttctggtaagaacatgccccaacccaagcacaagcaggacgacatcagcaccatagggacaatagtgaacttggaagaggcaaaaggacttatggcaggatgggcagagtagaggtgggaaggaggtgagacccccacctagctagaccgaaagtctcaaagagggcacaggagtgtgcttaaggtgctgactacagagaaggggtgctaggatatgagacagtgacatgaggtccttagcagagctcctggccctcctcgatcttcattaatggctagcctgtcaggaaggaggagccctacaggcctcttttcattttgcttttgaattataaaagtaatacacattaatagcccaaaactggaagtggcccagatgtccatcaacaggagcataattaaacacaccgtggcatatttacactgctgtaaaaataaatgagctgttgatgcaatgaaaacattgaaggagtctttaaaaatgatgcggatataaaagagtacacgctgcaggattccattgctatgaagctctaggacaggctgaactgccttgtggtagagaaacagggcagtgcctgcctcaggcaaggcttacagaagggcacctgagaactttctggaatgacagaagtgttctgagccatggtagagtttgagttacatgggtgtatgcatttctcagaacctgttgaatggtacaattttgtggtgggaattttaccatgtaaaatggcatctaagaataaaagacccatgaattgtgaatgaactctacttaatgagatgcaggcaggagtgctgaggggtgaaatggcctggtctctgcagtttactttgaagttcccacaagcacacgtggacatgccctgctcttaaaaaaataagatggtataattcttccaactttcctgaatgcttgaaaacttccatagcagcatgctgggtttaaaaacactacatagactcaaaataatttaagtaaagtggggaagggagagagagtacattgggcagagaccacattgcttctggaacattatccagggagtggcatccggggtctctctgcttccaacctcactctgaccagtccctgctgccccacagaacactggcctccttataatgcatattccaaatgagacttcatggacatgccttattcattcatcagttacgttttaagcacgtggtctgtgcccagccctctgccaggtggagggtaaagtcagacgtggttcctacccttgcggtgtctgtaatctagtaagctattgttcagtgataggtttagaaaagaagcagcctcgggtgcaaggaagtggacccagcccccaattattcagaaggtattacacaccaggccctgttcaacagttttaacgtggattaattcagttcaacctcataagcaccaacaaagcaggaactgtattatccccattttacactttgaaaaactgaggcttagagaagttcagttacccatccatgatgatacagcaagtgaatgaccaagaagagattcaaaacccaggaagttagctctggagtccatgccttaaaccagagggttgcaaacattttctacaaggggccagagaggaaatattttaagccctgtggatcatgctgtctccatcaaaaccactcagctcagctgctgtcgtgtgaaaatagccattgatgatacataaatgaatgaactgagttccaataaaattttatttacaaagacaggctggagccagatgccgtggctcatgcttgtaattccagcactttgggaggccaatgctggaggattgcttgaggccaggagtttgagaccagcctgagcaacatagcaagatcctatctttacaaacaacaacaacaaattagctaggcatagtggtgtgtgcctatagtcccagctacttgggaggctaaggcaggaggatcacttgggcacaggagttcaaagctacagtgagctatgatttcacctctgcactccagcctggacaacacaatgagacccagtctctaaaaaaaaaaaaaaaaaaaaacaacaaaaagaggcaatggcaatgactcctgccccaaaccatccatagctgcagcagctgggagatgtttgagctgggccagaaggcagctgaaggagccctcattcctgcctgtcacatcctggtggaagtacaagggtcagacagcaaggagtaaatacaggctttgagagcccaggtctctaacaatgaaaacacaaaaatacacccctgggtgtgtgtagtagttcatgaccaaaggaaggccatagagaaaaaggtgagaagttaaaaacacagcaactccacaaaagagtgagttgcctttggcctctggaaccagatttagaatttcagccacactgttcttcgagatttcatgtgaacataggaagagtaaagttcaaaagctttggtttaacaggattccttttgaaaatgtttggccaaagggaattttcctgctaggagctttgctgtcactggctcttggtttcttaagggcatgaaatcactttactaagttcttgttgctgacaagggtttgaccctggagctcagagggcaagctgtgctggaaatgcattgcccctcttagaagatatctgtatgcgcagtgctgaaagttaagagctcaaaaggattcctgagtgtttatctacagtttcacatctacccaagggtgactgaggatagctccaagagcctcttcctctctcctaggggttgccatcttgctctgaggagcccatctctcccattcaacattgaccagaacacaggggattatcatagtcagtgtggacagaatatttggaggaagaaaatcttcagtacaacccatttgcgatgcagtcttgtatgctggcctctttataccaacccagctgatgaaagtaggaaagtctatccgcagtcaggttgagtgtgtgcatgaagttaagccaccagctggactgcgacggggccgatctgccatttttccacactgaattaaccaggttaagccattgctctagtgtcacagagatatgacttgagtcttcctttattctcgggaaggcatttggtggcagggaagcatgttccagctgggggccagcaaatggttgactcacagggattgcaagtcacgagagaaagagtccagctcaatccctctgtgacaggacatcattaagtcacatcttcacagaaagggttggctgtttagggcgtatggtgtccctattttctgtcctgtcagaaaataaacctgacacacccacctatggagactccttcccatatgcacactccagtagtgaactggtgcagtcatgccaagaggtaccttaaaccctgtcagaagggcccagaaccactcctactcgataattaccacttagttgtctaacagaaacaatgcacaaatcaaccagcctcactttcccttcccaagaacgtagagaagcttttcactccctgcaggagagtgtacattggttggggtctgtagtcctcaaacctgaatgcacacaagcatttccaagaaaacatgtgaaaaatgaatgtcaagatcccttccacagaacccttggagaacagaagtggatctgagctttatgctttctctaaatcagtggttcttaaactttcctgtgcatcagaatcacctggagttaaagcacagattcttgggccctgccccagggtttctgattcaggagttctgggtggggcctgagatcctgcatttctaacaagttcccgagagctgctgccgctgctggccccaaaaccaccctctgagaaccactgctctaaggaatctcttctattttggggcagccggcctcatgactttggtcaaaggcagaagcagtgtcttctctacatcatgaaagaaactatttggcctttgtcagccaagtcagcaccccagtactctctacctgctctgcttgatattatagccacaaccacatgtggctctttaaatgtaaatttggttaaagatgagattaaaactgtttctttttttttcagttgcatgagacacatttcaaatgcccaacagccacctgtacctaatggctaccatgttggagagcacagatatagaacttttccatcaccacagaaagttctgctcatcagtgctattctatagaaactccaaggctgggtgcagtgtctcatgcttgtaatgagccactttgagagcatgttgggctgcttgtaatgagcactttgggtggccgagctgggaggatcacttgcttccaggagttcaagaccagcccgggcaacgtagtgagacctagtctctacaaaaaatcaaaaatcagccaggtgtgatggtgtgtgcctgtagtcctcaggaggctgaggtgggaggatcacttgtggctgggaggttgaggctatagtgagccaagatcacaccactgcaccccagcctgggtaacagagtgaaaccctgtctcaaaaaaaaagaaggaactccaaatatgcttctctttttctcttcattggctgttatccccattctgcaaaaaacaaacctccaaaaatccctttactaacatcagaaatggaattttaactttttcttctgttttgtttgctcacaacagcaaccctcctccacttcttcccatcaagttaggggaaggacagagacattttggtgcaaaagagatgaaaagtttattcatatttttccattgcccatgtcatgaaattcatcctaaaagcagtacgggtttgagaaagtaaaagttccccagaggtaaaggaacacgtggacagggatgtgttgtgggccacaagaatctcacagtcccagatagagggttcaggtggccgtggggcactccagccaggggcctgctattgagggtaaggccaggatgggactgagagtggacaagacaaagacaagccttgggtttccagaacagcacacgtctcaagtataagctgtggagctggctgctgaagctgttgctttttcattctagaggggagatgtggaatcactgctactcagagttgcgtaggcagatgccttttccaaagcctaactctgctttggaagcctagcttgtcagaagcctaactctaaccctctcttacagatccggctgaatagcagggggctgatctactccgtaggcttgctcctggcctctgtttttgtcacggtaggttggcagctctctcctcgtacttgtgtttgcctgttctttcctccccttggtttctttggagaccagatgagcttggtctcctggtgactgggtacaagcaacctccttgtcccatctcctggctctttcttctagaagtgagtcctagcaacccactagaacaccttctccctttctgaaagaagccagccttcctctcaaaggcatggccctatcttacatagaaagcaaaccattttcccaaacacaaagagaagatcccactttgtctgcaatatgagtcatggaaaggtagattccaattcattgattgttccaggttcccatacgaatccatgaatttgactaatacttggaaactaaaaatatattttattgacagtacattttgaggccattccactctctcagccattacgcccacttgcgtactttaatattcccaactcaactgttgtgtttggaacaagttcacaccaacgcatggactcatccacatgaagcatccattaacatacaaatatgctgttggcattaagcagcattgagacacaatatgttttttccttaattattcaaggaaatagtcattgagttacacctggcatgttgttagcataaatatgccagagaatgggaattcagaaggacaggcaggaagcaaaataagtagtttacaggatcagggtgtgaattgaatgtcaagatttcaccaaagctaatactgccttatacaaaagtgcaaatcgacatcattcatgctcttatggtttaggaggtcctgcagttctgctatgacttggagtggtgatatttgtaatagccacacgccgtacttaatgttttgtatacatatcttcccatttggagctcatcatgccccccatgaggttcactaagatcaacctattatacaaatgagcgactgaggcctagaggagctaattgactcctttttattgacaccaagtgaatggaggaacaagcatctgacaccagggtgcacaatcatagctacggtgcatctttttaggctatgctatagttataccatctacaggagacctggctaaccactaactgggctgtcaaaatgaggttaccaaaatgctgaagagaggcaggtttgggggaggaaaagcaattttaaacatcttaagtttgcaatgcctgtttgacatccaaaggaagaggtcaagaaagccattggaaatataagtctgagttcacgagaaatgttcagtctagagacaccatagtgtagatggtatttaaagccctgcagttgggagagatctccaagggaatgagtgtacacaaaagagagaagagccccaagatctcagtgttgaggcagtctgatgcttacaggtcaggatgataaggaagaaacaccaaaagaaacagagaaggaacagtttggagatgcgggaataaaaccacgagagtgcagggtcctggaagccacctgctggagggttttccaggtggagggagctattggctgagtcagggagaggagccctgagcattggccatgggagttagcaatgcaaaaccattggtgctaatgagagggtagtgctgtggagtcaagtggaataagttaatagagaatgaaaggagagagattggagaccgtgggcagacattcacaactctttcatgttatctgactgtaaagaaaggagaaaaacggaaattcaggaaaaaaagtgttattttaagatgaataagataacagaatctttgtatgccaattagaataatccagggatggagttggggcatgtgctagaggagagggagttgctggaaccaggtccttaagaagggtgggagatgggatctggggcatgcagggtggagttgacctcactgccaggagagaaggcagggaggtggggttgggagctctgtgccgtggggataagtgaggacggggaagtgagtgtcggagattggaagaaaggggagaggtgtgaagtagccgtctggggaagggagagacaagggactagggaaggatgagatgcctgctgaaaagcatgaatgacccacttaatgtcagtggtctctaatttaaaataagacccatccgcatggctgaccgatttcctccaaccctgatggacagctgcgtggatgcagcatgaaccagattgggacttggcttgaactgaagggctatggcttagccaagcaaggacaaccaagcaagagagaggccagggaatcagggtggatgccccggagtgactccagcgagtgtgggtggaattgaatcagaggaaggagagaaggaaacgggcaaagtgggtgaagcctagagaagtggtgatggtatcaatgaggtgtgggctatgggcatttgcagagttgtgggagctggggaatcaggcggagtaagctagaaaggaagagatttgagtcagaaagtgggatgagtgacactaagataagacagatgcttctgtcactgccaatagcaacatctaggccccagtgccacccagcagacctttctgcagtgaaatggcctacacctgggctggacagtaccactggctatggttggctgtagcacttgaaatgtggagctgtgttttaattttatttcatttaaatttgggtagcacataggctggtgggtgtgagtggctgaggccagatgaaggatgaggacttgatggggcagggtgttggaaagaccctctcccctctggaggcattgaaatcacagagaaagtcagcaggagtgcagtggagagtggcaagagccgggcggaaagcttcaaggataggcagtggccggggttacatcgttggctgcaacaggcagaaccaagaggaactgtgggaagaaccgagattccaggctcagtgtttttagggaggagagaaggaaaatggtctggaagcagccatgatttgctgtggggagggaggaacttctcacctccagacgcagccgtaggaagagatgcagccgccaccgcctgaggactgaggggtcagtgtccccaggggagtgggggcctgcttaaagcaagatggggaaggcccagaacagatgaagggcccacaggggtgtggagttggagcttcgtgaaagagggttggctgctgggatgtgcttgtgagtcctgccatttgttttagttatttttctacaaccagcagcttctggcttcctttcttcctgatgttgatgttctcacctcccacaatctgagacgagaggtggattttgcaggctcagagaggatcagcaccctgcccgaggcccatagtcagcagcccttccccgggtcccctgggttcccctaccaaccccccaaaggctgctgcctcctcctggtgccctctgaacctgttctgtgccctgcaggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatc

SEQ ID NO: 38493 - DNA, 247292 bp, Homo sapiens
aggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggtaaggggcacccgggagccgggggccagcctggaggaggaggtgcccgggcagaggaacctagtttttgcttctgcctactttaggggatttgcccaaaaccatcttgtaagacgcatcgatggcaacatgatgctgtcggtttacccagcgccaggaacccggcaggggtatggggatgatgaaattgataaacgcacgggttcaggcgttacaacttttggcttggaggtgcttgtgtgcgtgttggttggtacatataaggttggactttctgactggcaatttagattgcattccactgacacaatgcagtggtctggggttaggatttttgaagccagatttttttttttttttttttttttttgtggtcaccaggaaagacagaacaagtgatatgtgaaagcatccatttgccaatataatgtggaaatatcaagcttggtttggcttggtcatggtatgctacttattttatttttccctattcattggttctctccctttatcttccttaaacccaagctccttcagatatttaagaatcaaaagtaggttcagccaggaatatttatgtcctgggttatcccatcaaaagttttttactgctgtctcctgaaatgccagactgccttgaattggattctggaagctggggatttgcgggaggcgattgaagagaaagagggacctttcccagaagaactccttcagtgacacgttgggccttgggattgccctggttgcaaggtttgaggactgccttttgctggcaaatattgtcaagagtcacggcagctactctgccagataaaatccactgaatcctgcagttaaacttttggcaagctaggagccacattgtttcgtagtaaactttgaagacgtgtttaactggtaaaatacagcaccattggaggctgagtgcatctgaagacttaggacaatgaggccaggccctggctaggttggaggcttctcaatgaacatttacagccccaagcacagtttctcagatgcagggagaggctaacctttgtctaggagtcctcatacagaggaacaacccgcagagggcattgcatttagcagaaacagatgccccacagctcctttccaaagctccctgggccatgatttgcggggagtgtgttcaatttatcagagcctgagacaccagaccagttccccagggtctcaagtagaataaacaagaaaacctgcatttagccttgcagatgaggaggtggatgaccaacctcctaaccccctccttgtcttactaagagaatatcagcactgggctctgaatgactgatagaaggtgatgtaaatatattttggcagtggcaccagataccagtggcgcatttgaagttctccttcggttaaaggcgtaacttctattccaaaggagcagaatgattgaggggagctggcaggtttcctgttcaagtgcagagggtagcttttggaagtccttagagagatgtgaccaaaattccttgaggtggcttttatggcctgatgatctgtacctctgaagagtttgtagatttttgactattcaagttcttcctaccggcctgtttcacttagggaatcctgtgcgctctggagcatgtgacccttggcaggtgggcgctctcgcttgccttcccatagagattgctcctcactagaaatgtctcccccttattttgtgaaatgtgcacgtgtgcattttggcgtgagcctggtttattgcagttggtgtttgcaatgcgtttattttatttcaaggtgtcatgttgaaagaacctgtttttaggcttttgaaagctcatataaacagggcttatcaccaataagaccgagtcactgttggaaggtccttaccaacagggggctcaacttcatgctgcccaaatttcgatgagtctcttttgaaagtacatacatctcaagccttgagattagagaagtgagacaaatgcggaaaaatttttttatatccgtggcttcttcccaaagagtattgcttgactctccttgaaaacacataatttatatgtttttacttttgcctctgagagagctgttgaggatgagatggtgagtgagctgcttatcatattttatttacattccttgtggttatctttgtcacaatctctgtttgctgtctggggttttttccttttcttttcctttcaccgtgatatagaaacatgcctgtccgattcctcagtgagaagccactttgccactcccaggctctgtggccacagagatagcagtggatatcatgctggataggaaacttgagaatgagttctgctctttaatgatgtctgagctccatgtgcctttcacaaatctttataaaccttctcattcgacctcattaatttttttctcatttatctttaatacaaacattctaatttagatgagccagagtgaagaaaattcgtcaaggaaacattcccagaacttcctaataggactaaggagtcaatttattttatcaatacctagaatcaaaagaggggatggaagaaaataaccagaccctttcttgatgatatagttcatattcgatgaagctggtttgagaagtctgtgtcccaggggagtgtgatagatctttgcgtagaacagtcaccctctaaataatggacttttgagtgtagcaactggctccgttgctcaggaaatggcatctttgatcaggtttgattatcattattgttacccacacttctgtgtccccacaaaatgatgctgatattttctgatttgaggtttagctgtttgacccaaatccagcacaggcaaagggacctattgccctgagcagagctgcgctgggtaatttctcattcagtcacacaaaccgaggcaagttcatctgctcccttgaatgttaaaacttctattgcatcccactcgagccctcgctgggagcttctgccattaaaaatataataggatcaaaagggatgtgaagatttaatttaccaccccaactttttacagtgaataaatatgaattcttctcttttcaccttcccgtctgcacagcagactttttttttttcttggaggtattgaggagtgttatacatttttaaagaagcagatttgaaacagactcctttcagaaaagtaaaggagacttttctgaacaaataaaaaccctactggtttttatgaaatagagatgagattacctctggccttgaaattttaaaatttgtatgagtttctggattgacttgatgattgtactgggtggatccctcagaagtaacaaacccatccatgcaagactgtgtcccatccataggaacaagtattttctcagagcaaatgtcttcactgagctaccagatgcattttctggaggccttgataggaggagaaagatgaatcaagactgacttagaaacgaaggaggtcaacacatccttaaaggtctttggtgtagttattactaggatagagtggaatgtgataggcgtatgagttctagcagattctaattgtgaagtttacatgtaaccatcttctcatgaggcattctataaaggttccaatataatcatctagctgtcttcactgagattaccatttctccatggcagattcagaaaaaacagctttttattcacaaagctggatttgagttttgcagcctgggcaattttttctgttccatccattacttcctttttcatcctcgttgtggccaatgtctgtgtactagcacttccacaagagggagaaacacagtgaagagtagggaggaccccagatcctgaaaaagctttcttttggtttcttctgaaacttttggttgatgaagtggttgaagtttccagctaaatactatttggggattttaggagccaaagtcctcctctgaggattatctcaccctttctctgccttgtcctatctggtagatgttgtcttgacttggagtgtggatcgttctagatttttcttctctatgatgatgccactttcacttttcccctgagaagtgagactggagaaccctctaaaacgtcaactggagaccattagccctggcccatcaggcagggtgaaaaccggcaaatctgatacttttccaggctgaccaaattgacaaaaggagcaaggattaagaatgggaagatactagtaacctgcttttgtggtgcaggcactgtgtgtggcactgtgccgaggagctttattttaactatctggctcatttgcatcctgtaaccacttttatccgcattttagagagaaactgaaggccagagagtcgaagtgatttggccagcgttgagcagctagaaatgaactgagctggagtttgaaccagacagtttggttccaatccttacttcttaagcacttcaccatagtgcagaaggataagacaggcacagtgcaatgtacatgttggtgctgttgttattaataaatacagttagagcaatgactgttttgtgggctcagagaggctgctgtcctatttcttgctgaagcagtgggttgaccaaaggctactctgtttttggtggctcaaatctttggtggcacataagctgctgtctcctattgaagttaaaattcacaagtgccattgaagagcttttcagctgaagcacatagcatttatccaaactagagaccttgaaagccggtgattagggtggattgtgtacacattcattccaagtttagacaaaaaaaaaatggggagaaggagggaggaggttggagattttcagagcggttgcttagaaaaaagcaacagctattattacagaggcacaggtttctcactaaacccattctagattttgttgttgttttcatcaattgtagttgagtaagcacaaaacatcgggccctattgttcataaagaaaactaggagttgtcattaatccggggccttagtctccctcaggaataaaatgctatcttacatcattgagtctttctccaagtttgtcagcaaatctctttcaagcgatttgcaaaatcctagcctgggaacaaactctgtgccccttgcttaaccatggcctaatggctgtttcgtgttgactgtactgagttatcttggagtgttaggcaacttttgcattttgtttgatgttccagattaggtccctcccataccaatacccctccacactgaccccattctaccatgaaaattagccttggaggagactctgggagaatcagccttacagcttcaagggtactggagatcaggctgccttctacaaggtattttattctgtgaatagcagcagttcagggacttgttagtggtcaggaaataaaactagtccagaacactcaatgactgcagtgtgcttctttcagccctgtggacacaaatttaaacagaggctttatataagtagagcaagaagaaatagttgagtcgtttgtccaaagacctccttaaagtctagtggaattagtctactgtcattttgtgttcacttaaaaaaaaagttgtgatccctatttagctgctaatcagtgataaagcatcagtgtattcaccaggtccaacccttgaggccaaagactgcaaaaggaaggtgtcagggaaaagacacagacttgttttgtgactggcatatttcaatgcttccagcatcttgacatgctcttccacttaatgctgatgccacgtggatcaataatctggctgaggtcttctttcccatgcctgatggcccaggattcctctgccctcttatgtttcaaccgagttcttactttgataagggaggctccagtaatggccttcttagccaggttgtttcctgaataagaaatcatttgggtaaaaaaaaaataacgaaaaaaaagcatatctgtctctttataaataattttgacacaatcgcttactagcaatgtttcagttttgtaacttctctgagctttgctttccctatctgtaaaatagagagatgtgctttgcagagattttggtatgtagcgtatagtaggtgctcaataaacagaagcacttcttaatgttgttatggttggtcactgtaggaatggagtgttgagtttagatctaagctcctgtcttctcttctgtccatctttcttgtccatctactacgtcccaagtactatgctgggtgtgggtgaagggtgagaagaagggcatagttgtaaacttagaggactcacggtcctattccttattgttcaaagttggacttaatatatatttcctagtatgattgtaactttcagtgtttctgttcatatgaagaagatccctagctagctcagctttataagccagaaccagtatgttaatgacctgctcactgtccacttgtctctgtctcctcacttggggaagctccttttattctcaatgtataggaaagtgcgacgcacagaatgcaattgtctttacagttgggggtgaagatgatggaggttcatatatgatagtgggtgttagggtatgggtgagctgggctgggacttgggggccacataccttgtggcccttgatcacttgggtccctgttttagagaggcctgggtgtgactatcctgaaaatggtctgagttgacatacctcttatatctcctttagtttctgccaggcggtggtctccaggtcaggatgaagtgttagttctctcatgttataaatgtagtaagggaagtcgtgctgaagttgactattgggaaatttcatgtatactactgagttgagagtccactcctccaaaagaaattttagataagtgaagccgttctagaagccatcaaatgcatgtttgctcccaactatccacagctagaaggttatatagcgtggcaagtattctcaaacagggcacagagaaggggtgctgtggtcagggtcccagaagcaacatttccttccactccagcagtgctgctagcagactctcatttaattgggttttattggtgatttttacttttccagccatactcatttccaagtatggagaaaatcaagaaatgtcagctaccattcattgcaggcttatttagtagtagtgtcagtaataataacaatagcagccacctttttcttagtatttactgtgttcccagcactgacctgtcctcccaacagcctttggcagtagagctggggttcatagccagcagactggttgtagggtctgcactcctaagcactgtgcctcttgtgtcatggagcagacattttgttttatatgaaaagcatatttaatccttgagaaaattctaagggacagagattttgttgtctcatttttctggatgatgtaacaattctccagagactacagataacttttgcttgagttcattaactacacatcttccatctcacctttttctctgcagatgaagccccagcttgttcaggcagcagatggtcataccttggcctgagggtgggtgttctagcccagccatgataataatctcatactggtccaaggattgtcagagaccagtttttaaccattgggatatgagaggatatctactaaagatactttaccttcatgaataacaaataaagcttcttggggaaatagccttttcctccttttctgtcttcttgctgtcctgagcatagatgtgatgtctagcattgcagcagccatattgtgattctgcagcaatacatgacaagccttaaaaccagtccactaagaaggctagcatgataagatggaaggacttggatcagtaagcagcacctgaacctacctcctaacaaaagttatatgagaaaaatgtgaccccctttcatttgtttatgcccatatgtgaattgggacttctgttacatgtatctttgacattcctaaccaacacagctactaagggaccaaaattcagattcaaacccaagcctccatatgttattcattgttgaaggttgaattgtgttcccctaaaagatgtgttgaagtcttaacccctggtacctgtgaatgtagctttatttggaaataaggtttgtgcagatgtaagcaagttaagatgaggtcatattgaattagggtgaaccctagagccaatgactaatgtccttataaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatggtgagagattaaatttctgttgttttaagctacccagtttatggttatttgttacaacagccctaggtagctactacaccagtgaaaccatatagcctcttgactatgtttggtcactctacttctgtgatgtaggtatccccaactttcacatactgcgacacaatgcatgtgtctataaggaatcctttttttaataccgagtgtgagtttatctactgtggattaaaaaaaaaatgaaaacagcaaacaactaagctattgcttctttctcctttatttccttctggtggacaacatcctaggaaaaggcagcaaaccttgagtgtaacatgtgctgtgttgctcagggaaggtcctctggaaaatatggtacatgagcttcaggcctgaagatggttcgctttggagatgaaacttatgggctggaatgtgaaacacagttactttgaggtggacctcagtgaaacttttccagacaggctgagaccaagggaagactagtattaaggattttatcctcaaaacaaactaggttgtcagagtccctgtaggctctctgggtagcagcctctgtgatttgcctcttcctgactaggaaaacctgtaagctgacaaagaagtatatttaaattgacctccaggtgagcctcatggtatgtcaggttgattatttgtacctggtttggtgttttgttttgttttttacttgataactgtataaattattttagtgaagagcctgttcttattctggaactcactttgaagacaaaaaaaaaaaaagtcagccatgtcataatacttattttcttgggcaagcttgtctttttttgatacagccaggaaggcacaaatgtttccagtccctctgagacgaaggcagggagcctgtccaactgcagaactgctctgtcagtgtctctttctgagagtgaagagtcattctggtcttaaaatgctgttttgcttttcattctcttctctagaaggaatatcccctgtgtccatgggagcaggaggggaatggacagttaccaggggaaaggagctgcataattgttagatccatcctaatcctttcatgacaaacctttcctcagagttgctttatagttgtgggtctgagaataaattcacagattcacccactgcatgctttgatggtttcacgtcaggaatgggcctacttttcctcaggtgagagcggaatcctgctgtacaagccacctgtaatgtgggcagtggcaactgctgtttcctttccaagtcttctgaggttgtttcctagtaagtgagctggaggctatggggcctggtcctggtggtagctattttgcttttggacataaaatcttggtagcttaatgtatttgttcctagggctgcaatagcaaagtaccacaaaccgggtggtactggtactgtgggttgtcccgcagttctggagactggaagtctgaaatcagatgctggcagggttaatttgtcctgagggctgtgagggagacacagctcctggctttctcctagctgctggtagtttactggcaacctttggcattccttagcttgtggcatcatcactccagtattcatgtgatattcttcctgtgtgtgtgtctctatgtcaagatttcccctgtttataagaaaaccagtcatattgggttagtggttgagcccaccttactgaccaaataaagtcacatgtcgaggtactacgggttaggatttcaacatgtacattttagagggacacaatttaatctataatagtgtggaattttcttttgggtatctaccagtcaccaagatatttatccctacttgaccagccaccaaaaaaaaaaaaaaaaaaaaaatggcaatcagaattttctctacatctgctccatgtcatgtctactactttcttgattgtaaaaaattacaaaataatgtctgcttagggtagcaaatcagtcagtttagaagtatgtaaagaagttagtaattttgtgccttttccaattcccaattctacccatgaaggaaacccatggtttccttctatctagtggttatttttccacatactttccccaggcttttgcaagtgtatacatatgtgtaaacacatgtttaatttttctcatgaatttcaattatatatatgtatatatatacacacacacacatgcacatatatatacatatatacatatatatatatatatgcaactttttaaaaaattctactttactgtgttttgtgggtatcttttctggtcaatatatgtagacccaactcattccttttagcacctgtgtagaattttgtggtgaagctggactataatttatttactcattcccccattccctcttgagggagtatttaggttgtgttcatgttctgttttttttccctataaataatactgctataaatttttgtgtctatcctgacctactggtgcctgtatttctttaggctgaactgccaaaattgatatggctgagtcagagtatacatgttttaaatttcagcagctgtcaatgagggcttttattgagagttatgctttttgatcagaaatatatattattttgacaaaggtgcagagaagatagttcactagtgtcttagtctgcttgggggctgctgtaacaaattccttagactgagtagcttagaaactacagacattagtttctcatggttcttaaagctgtaagtccaagataaagatgccagcagattcagtgtctggggaaggcctgtttctgattcatagaaatggtgccttcacgctgtgtcctcacataaggtaagggctggatgagctctcttaggcctattttgtaagggcactaatcccattcatgaaggctacactcctatgacctccccaaaggtttcatctcctcataccattaccttgggcattaggattctaacatatgagtctagaccatagcgactgaagaaaggataatagtgttttcaacaaatgatgctggaacaattggatattcatatacaaaatgacagtgaaaacatcaacaaacccagatacttcaatccattcatcatgccatttacaaaaattaactcaaaatgggtcataaatctaaatataaaacctaaagttataaaacttctggacaaaaacagcagaaaatctttgtgcctttgtgtgtatctgtgtaaacattactgcaatcaagatgatgaacatattcattacatcccagagtttctctgggttgggcagagattccttagaacaatgacaaaaatgcaatcaacaaagaaaaaattggactttatcaaaattaaaaacttctgccctttaaaagatatggataaaagaatgaaaaggtaagattcaggctgggagaaaatacttgcatctcatgtatatattaaaggatttagatctaggataaataaactgtcaaaactgaataataagaaagagaatccaatttttaaaaaccaggaaaagatttgaactaagaaggtctatacctggcctgaaaagatgttcaatgtcattagtcattaggtaaatgtgaattaaaatcataatgaggtatcactacacagttattagaactactgaaaaaaaaaaaaaaactacgaccttgctaactgttgatgagaatgtggaaaaacaggaactttcatacgctactggtgggaaggtaaaatgatttattcagatcagtagttacctgaggatggacttggagggaggggcctgaaaggggattggggtaagttttggggttgacggatttgttcaacatcttttttttttttttttttttttgagacggagtctcgctttgtcgcccaggctggagtgcagtggcgccatctcagctcactgcaagctccgcctcctgggttcacgccgttctcctgcctcagcctcccgagtagctgggactacaggcgcccgccactacgtaggcccggctaattttttgtatttttagtagagacggggtttcaccgtgttagccaggatcaacatcttgattatgtgatggattcatgggtttatacatacattgaaaacaaatcaaattgtgcagcttattatctgtcaactatatctatacagagctgttaaaaatgtgtatgtgaaatcctcattatttgccaggcatagtgctagatgttgggagaactaaacaatacactgtttctgttctcactcctgagaatttttcatttcctttttactggaaataaaaattctaacccagaatataaataatgaactctataatttttcttggcgttctcttcttttaaaacatttcttcatttagttcttgaaatgacatttttcatccatctcagtttgcctagggatcttagtcaaactagtggttgagcaagagaacaaatccagaccaaagggtggaaagttcacgttgccttgttgattcttcctcattctggatggccctgtttctcgttcatgctcctagttcatgcatttttctcctgtttctagcatgttggtgttccagctgactctcccatctggctcagtcctctgagaccttttccagccctgtatcacagtgcctggctccagcctccatggccagtagactcaggagatattgctgttgaaagggtaaatttctgggatgtggcccctatgactggctgggctgccttcttgttatttttcctcccgtgacagaaagcaaagagcaaatccatcatgcaaaaccattagtgggtcttgattctagtttgtggattaaagtaatgtgtgtagcagacgtagggtctggattccttgtgaggcaattgtttttctcaggaatatggcaactgaaaactagacaggatggaataacttcactagtggcaactgaccctcagtaaaaagctaatgagaaacattcacaaaatgactttaacctagtagtttaaaaacattttgcccctcaaggaggaaaatttgagacattcaactcaacctcctttaaggtcaagggtaaggaatataagactttgttcaataaataggtaaggaaacgatgtggcatattgtccagtctggggctctgtcgaggtgatgaatgcattgtaaattaaactggaacagcaggcataaaccgagaatcccctgtcaacctgtacgtgtggttatcctgagacagcaagtaaactactgtacttctgcttctaactctattttgagggtgaaggaaagaaatgaaatacattgaagtgagggacatcacgtggacaggaaagccaggaagaggggacaggagagtcggaggggcaaaggatgtgcacacaaagaaagagagagaaatggtaggctagaggaagtcacacgagcagttagcactgtccctggcacatgaatgctccaccataattatctataagatatggaatgcagtggttggatactaatacattattacttggagccaagacatcacatgctcaccctgctcaggtgttgaatgctttggtggattatctgactcagttggaaaaacaatgccctttagaggaagagcttggacactttgagggatcataaaagcagatctaaagccacaggggtgagcagtttgggggaaatggggataatgagaatatttctttagattacaagtcagaccacttgtaacccattcagactgttaaacagtggaaagaccatgggtttttaaattaggcacccatagttacaaatcttggctgcttcacttattaggagttatttcagagcctctgatatgtattttgtgtttgtattttctcaacttaaaaataaggataatattataacacttagctcctggttgccgtgaatgttaattgagatatggactacaaagagcgtagcttagtatccggcacatctttgggagtcagataaatactaatatcttcccctatttcagatccaagggtaccctaggaataaaagcatagaactttacagccatgtgaataatagaggtttgctgtttcccaaagtgtgtcccatgaattcagtgtgttgctcataagtcttgccacagaagtttcagtctttaaataatttggggaagccttagatgaaacaaagtcaggctgattacttagtgcaagacttcttgtagcatttaagatgccagtgccctgggagtttccaagtgaaggaagaagacagctttagctcctttgtaaagaagcattccattgtccagggtgcttcaatacttgaactcctttaggttgacaaactgtgggcctgaggtttggctttagcttgcagaaatatttccttcggctccttcaatatataaaatctttacaaattcatttccagggttcgaaaattagaggaatttataagaaaatctggacttcttaattcttttgaaaaacgtcagatcacggagggcttgaattttcaaatagcgaccactgagcagctgctgttccatctggatggaatgtggcctccagctggttctgagctttccttggtgcatctcactgagtcacccagcttgctgagccctgtggatacttgaattggggacaccaatgtagttcagctccttcatttggccaatgtaaaagctgcctctcaagttcaccttgtgttggaaacagaaccaggtccttggtcttctgactcttaaaggccaaggtggtaactgattttacttgtttagcaccattcattgctctccaagtacagctctcgcagcccacctgcaggtgcatggaggccaacttctgtcccctctattttgagagctgtgcgatggagttttcatgattggagtggggagccatggtcattgcttgtctcctgggtaaaccaaggcatagaaactagaagtgttggggcttatcctattttctaatccagagcatctgggaggggttccaggcacaagtgggaggcttcttctacttttaactaaatgcagatccctgtttcctacatatcccacgccaggcaactaaaacttctcattgttatgatattggattattttggggaattttactgccaaacattggaagagattacttccaaaaatggaggacatgtagagggtggagaataattttttaatttaatggatttcaacatattcctcacagattatcagccaatggaagacccattcaaatgccatttcagaaaacccaaactgaaaaacatccataatggtggtaatacctctctatttagagaatctccgttcccaccaaaaaacactcaaaagcactttgcagacattttactggtcatcttgggagcaaacttactgctgctttcatttactttgctgagtgtggaacccatctgcttaacgctacccatttcctgcagttacaggattctgatgatttttagcataaacatacttggaatcgactcacacagtggcttgagctatagaacaatgaattagatctcccaccctcaacccatctacttgattcatgaaagcacggatgctgtgtgcattccagtccctgagatatccatcatccatctgagttggatgaggctattatagacttgagacagttgtctattgctctccatttgacccccttcccgtaaaaagtgaactctattgataactatttgaaaaaatattgcacactctaatcacattgagatttagtgtgcatactctctctcctcgaatctgtttttcctgtagcaccttttaaacccagaaattcatctgaaatagtttctgctgcagaagcttattatttctgcagtagcagaaaatgaaagggatggtgctgcccacagaatataaaagtcctggccaaactacaaactcagaaaatacaaatatacattagacccctatatagttctgaaaaggttggcttttggttagtaagggaaaacaattcacatgcttttgaagtacttgtcaataaaagagaaacatatcatttaaacattaaaacataccatttaaacataaaaccccttgaacaccagtcatataatgaaaggaggaatttagttgtgcctgaaaacctagactagaattataaccaaggtcataactcggcctaaaacttttaggtctgagcttcctagcagcccgaggaaaaagagaaacatgattagttacttaaccttcatggcctaatagaagaatgtatattggctcatctggagccctgacgtttttctaacttgaaggccctggaatttatcatgtggttctttatatgggacattgtaacgcagacttgggtaatagcattagttgtagtttttgccaaagttgtccctagaagttgaaaaaataaacagttcaataggaatgctaagactgtttatgtagaagcagaagtggacatctgtgttttgtttttgtttttgtttttttgttcagcttcatttcccatcttctggtaacaataccctgattttgctttggggaactattctatccctcttcagtagggagactccattcaattttggaggtttttttgttgttgttgttcgtaatgaatgtgccattctttagccacggggactatgtgtgacccaaactagattgattagacactttctcccgggagttggaatcctcagcagggtgacaaaaagacaaagtagtcatagctgacaatgctggcaaccatttccgaagaaggtctgtcgtcctgctgcccagaccctggtagtggctctatccctctcctttctgagctgtatcctctccctctcctttcaattcagtgttactccaatattttttctttctgcttaagtcagccagagttggtgtctgttgcttgcaaccatagaactgaatgatatacaggtaacatttcccttgaaccaattgatgttcagtcttcaaattctgtttcacaaaaggtgatatgtggggcagagcatatgtctggggaaaagtgaaggagccatgcttgaaagctctgtaaaataccagaaacctatggacgcacagtgtccttgtatatgggtacccttccgtgtaaaaactgtgcatgcttaactgggagatggagaaagggtgcaatttttttttttttttttttgcttggaatttcttttaagcacatacccttactttattaagtgactttgaatgaagataatcctcattttaccgtagtactggcccacagcttccaggttctggcccatctttggagaaaggttttttggtccttgttgtttataagggtgtagtcctgctattggcatctcctataaatcttaagatttttataacttggatgtcactctcaccttcctgccaaattgctgcactgaaaaagcagagtgtcattttaagtaatgatgcttttactgcatccaaaacaaataaagtaattttggtacacattatgaaacaaatccctcttatctctgagcctagagtggaaatagtgtcagggatgcaaatagctgctttggccaaaatagtcaaagaagacatggccttagtctgtctgagcttcatttcttaagaaacatttgtagttgttggttaaaaatgtgaatggctctgtaagttcactctaggacaatgtggattctttagcccagaaagttaaatacctccaactttggcagtcctgaccttctgggtagagaatatagttccccagttttcaagacctgctttgctactttgatttaacacaaggcagaaatcttcaaaacaaagccctctggatccaggaaagttcatctggcattagttagcttggcaccccctacccccttccccacccacctccttgtcttttctctaggaacttgatgctttgtaggaaatgaatggctttgcaaaagtgcaaatttggggaagtgttgtgcaaccaaagaaattcaaattagtattccccttgtgggaatcttcttggagaaattatattaaaatattcaggtatagagtacagccaatatctgttttaggaagttgacagactgagtgatacagctcaggggttttctggaagtaaggcaggctagggaaagaagaatacagagtttaaaaaacctactaatttatgtctcctctctactctgttaatggtaaatagctcaagctcaatgctgatctctttactccttgacccagacaattggcatttttcttcataatgtaattcaatgcccttgctgaacaggagctggcccatgagatatgtatttgctctgcactggaaaggatgtgtgctggcacgtcctaggagtaggcaagcagttgatgaaacttagagggagtcttttggaaatcaaaattaatttgcatttacagggatcccaactttgcaagtaaggtggaattgctctgttatttgtgaccacatctgtgttttctgcccccaaattaaaaacacaaaaacaaaaacaactttcttcctttcttgcttctctcttcctcctttccctataattaatgggagtgaagttctttccattcctgatttctttgaactctcttgctaactgctgagccttttagacacttttttatggctttcccaaggggccatcaccacctctcctttcttccatcttcctttttcagtggctgtaagctcttggtgggctggaagacacaaatgaattggacaaaaacaaatttggctgttgcttcaaagccattgcattctttgtgtgtttttttttctttcttttttttaagcttttctttttttttttttttttttagcttatggttaagagggcattatctttgcattagatggccatcaaaacttatttattgggttatagatgaagagaacgaatggacttatttcgatccaaggactggaagaaatggacatattgttgatttcttgtaaaatgcactgaatgtctacctcagaactttagcagatgcctgcttctgctaatttaaggaactgatgctatttgtctttttaattttacataggaaatttaattttgatttgaagcttttaatgcctaatggtaaatatgaaaatgtgtgatagagcaaattatttttcatctcttgcatttcttcgtgtatctcacactcaggggaatttttatgtagcataacgatttcataagtgttaacatttaagaaaattttcacattataaatatgagcagaagcctgctttagaaattggaaaccaagtttggccaaaatgaaaggcaaagtcatggctatgttaaaactcacatcttggggagttctgggtggtatactgacagtggaatagactcagatacagtgcttttagtattgattagtaattcttgaccaacggatcttggaactcaagagggccatggaattacttccaggccactgttaactttctgtgcattctacatttcctatacactgaaaaaaaaaaaaatacagtaccttgcaaatatttcaattacttttcaaatcttgtgtgctttattaaaagaaatacttatttgaaatcattattgattcacagtggcttttggactttaagtgcattttcagtccttgagcatcaaagtactatgtgtgggtcggcaacattttggatgtaaaaaggatggtgatacttgaaagatttgggcactcttgaattgattgatggagattactgtagggtaaaagtgcactgactgtgatttggatttgtcacagtgcttctcctcgtgttaatttcccatagtctttactttcagcaaatgttgactgatcttttgtttttgagtgaggagccaaactgagttttaaggtgggtataaagaagaggtccctgtgctcaagaaggtttcaatcagttaaatgccgggtagatccatgttactacaggggaaacttccatcctaagacgctgtaaagggcaaagatgagggtcttcatcatcattgggtttttattaggtaaacaaaagcttcccctcgagtcctacccagaaggatactaacacctcagggatgagaactgtgacatgtgcccaaatatttgcttgggaaagaaaatattttaactgggcacttttttgcccccaaccaaatcggagttctgtcaataaggaaaacgagaaaattggcagcatcataccagccacctctaccacaggtgctgagtttaaaataatggcagatgtggaagatgcgatatccccagatgctgtgaacttttttatttgccgtagaacctttgtgcttttttcctgtggtttggtgcaataatgctgaaagcaacacagtcctctgatttgaacagtcagttgatactgggtctgatatggtatcagatggttttctagcccatctttaaataaaagcattttgtccaatggcatgtgttgaaaactgccaagagtcctaagaaagaaagactcttttttgtgattaaaaaaattgcatctgagtactcagaagttgggaatttttatgtttgtttggacagatgctgtttggataattttctatttgggaaaatatcatttggtttataccttcttttccttttatttcatttttctgcagtctttttcacattggatgtgagcagattgtagggaacaaagccaaattaactcaaatatcagtgattaggtgaaacaatttcccttcactttctgtagttagtgtttataaaaaagtgcctttatcggatgctaaggagttgctttgatgctttggttcaagctcttaaaccatcttcttcatctctctctacatccttccatacattccagaccatcttccacagttgtgtgttttgatgtttgatgcttttgctaatgttgtttcgtaactttgaaatatccttttctgtcagccgcctgctctgcctgggggatcatactcctgtcagccgcctgccctgcccaggggatcatactcctgtcagccacctgccctgcctgggggatcatactcctgtcatagcagttgaagttgcccctcttctgccaaagtctttcctggtatccagttgcaatgagtcatccctttcttctgggtgtccacagtttgttcttctgcttcagttataccattcagctcattcttgtttttctttttattggaattatgtgtggacttctatcttccaaaagcctagaagctgagggctgggtctttgttcatctttgtgtgccccattgcacatggaataatacttggaatacaaggccggcaacaccatacaagctcagtgaatatatttatgtcatgcttcaataaactaatgatattttataatttattttttgtcatctctcttaatttctgtggatggaaaggtaagagatagagtggcataatgagcatgctaagagaagaattttacttttgtgttgagagaggtatttttcttacatttatctttagagccacatgttaatgggggaaaatgcacaattctatgtgtttatattaaacttttttgaaatgtgttctggattttcttgacatttaaataaagatattatacattgcagatagcttgtacccaagttatttctacttactattagggacattccctttgttatatttaatttcaggaatgcaagagatggcaatagttggagctattcataaatggcaattaattaaaaatataaaacatagaatctgtcttgttcagagttgcatctgttttctggtgggctttcagatgggggagaaagttttaggttgcttttccttgtgtaaaacaaagtgagctccatttgagcatcatcaagaaagccagaggtctctaagattcctaaacacattatctgttgttgtagaaagcaaggaagtgctcagaaaaaaaaagttatttcaacatgacacagaaggccccttggctttcattggacaaatttagtacacctcaaaataaataacagcttttgaggattttagcactttaaaaaaaaataagtctatgagttcatactaatataaactgatttaaacaaaggaataagcaaacaaataaatagataagaaaggtaagctcttccttacaataaaatgttacctaataaataaagcagggatgatggagttagaaaatcaccattttcaatcatcataataatatttaatccaggcaagaatcattagtgattataaaactagtgtgtgaatgttttatgtgggacaggttatttatagaatctcaaagtatctcaccagacactatcagttgactacaggaaaatgctaactttccactggaaaagtccaatggaagaaattaacttagacaaagaatcaaagttagcatcacccataatgaggcaaaccatgatcgtctgcctcctgatacaacgcactgagaaggctcactcgcatcatattcctgttccaggagcatgtattctctaaaacaactgtctcaggctcttcaaaaatatcagtaccatgaaagagaaaaaaaggctaagaaactggtccagattgagtagacatgacaacccagtgcagtacatgatcttgaatttgatcctggaccaggaaaaacattagtataaatgacttcactgagttagttggtgacataattttactatggttaggcaagagaatgttcttgttcttaggaaatatatactgatatatttagggatgaaggggaaatagcgtctgtatcttactctcaaatgcatgtgggtaaagggaggaaaaaggtaaggaaagggaagagagagaaggaaggatgaggaggatgagaaggaagaggagtagtaagagaaggaggtgggagaaagtgaataagtgagaatgacaatatataataaagcaaatgtgataaagtgttggtggttggtagatctgataaagctgtcttattcttgctgtgttttggtatgttggaggttatttccaagtaaactgttaaagaagaagacattatgcatgcgtgttcataaatgtcacttctagttgttttagggagtggtggtcactgaagtgtctgtgcctaaaggcaggggctgttctccagtgcagagcctagtatccggcaaaagtaggtagtttctaaatatcttttggatgtttgcatggaccccaaggccctgaattccctcgagctgtaaaatatttatcttccaaccattgcaaatgccaattgtaaagaaatattttgctatttccaagttcgcttgcactagttatgagatgttttgctatttccaagttcacttgcgctagtcctacagcaatttagttgtagttggtgggacataagcagggatatcttacaggcaggatgcatgcatctctgcactcttcttcctgtaatctggcaggaatataaatgtgatggtcatttgagaggcccttttaagccatgtgagaggagccatgtgctaagaactgtagaacataaagatgtgtgagttctggagctttcatactagccttgggcctctcactccaggctttgtttctgtgtgagagatggaaatgtctatgtcctttaaaccaatgttcttttgctttatctttcatttgcagctgaagctaatcctcaatgatacaccgtgctttctagaaatcatcattgttaaatttttgctcctctatggagctttgtattcagtttgccccatatgcacattaatgatagaagttttctggttttatttatattccctttctgttttccctgagtagaatttttcttattgtgatgtggattctgtttctgtacttgagttggtgggtcattgtctgtggctttggttatttttactgctgaggctaccttactttttttccatcatgataaaccttctccattttgcaaattgctaaattggtctgaaaagattgtgagaactggctttcttaggcgacttcttgtgctgaccaacccagctggagaccggatgtgcagaggtaagcacttggaataatcagaaaataggaaattttaactattcccagttgccagagacattttgcttcagttgaaggattggaggcaggtttttataatgctggccttgcctagtgagttttgttgagcaaatctttgtactttttggaatccactcatgtttttatttgttccgtggatggttcttcctctgcaactatttattgccactaaagtttgcggcacagtcagtcccacagataataaatgggtgtgtgtgcccacagctcaacatgaatagagtgactgacttccagcttgtttattgttagacgggtatgtaaccaaggaagcctaactcttcaattatgtgtatgtgtgtttctgtgtagtgaaatatgggcctgaaaatggaccttgcagggatattgcatgatattccattatttcctttacagcaattatttttcaaatgttacgtgaatgaggatggtatttacttgcataatttcatagttatgttatttcatgacctgaatgccagcagctccgcagtttgaagcatcatttccttctggtaggctggctgtattggctccctggctaatatgaatttgaaagataattgataattacctaaatgtaaagcattgcatttggaactgctgtgggtgaggtcttccaactttttaaactctaactagcctagacaggaatcagcgattgctattatatgcaaattctgtttttatttctacagaaaagagaagaaataactcttatttgttcaggtttaccaaagaagtacctgtcacaatttggtctgcaaaatgaaacaaacagagcacgaaaaacagcccaacaaccaacgaaactacagccaaaatgaaggatgcaggataaaacatgacttaaacattcccttggcctaagtgaacgtggtataatgggaacagggtagaactaggaattgggaaattttcagggaagttttagccctactaagtactgtctttataactttgggcaagttacacaaacttctgagcctcaatttccccattcagcaaaatgagtctaataaaatctacctcattagcttcttctgagtgtgaaatgagataatatatgtaaaaatgtttcataaactataaaatacgttcaagtattttttatcagtctgctgataaaaggtgtggcatagctgccccagacccccagtgctaattgtcttggtaagcagcactgtaatttgcactctaagtaatagtaagtgttaagaatttgtaagaatttttaatgtaatgtgcacaaatctattctgattaaaacaagtagcatcttcataccttcaggattataattgttgttagtaaaggctgatgagagggaaggaaagtaggcaaggcaatacaagttgcctttttcacttgaacttgggaatgaggagtaagaagcacttgagcttatatccaccactgcatcttttaccaggaggcttggagtgttacaagaagcatcattttcatcttggccttgtttgggagtagggaggcacatggccaagagacaagctttatgaagtcatgtgctccaaagggaacacaggaaaaagggagtgcaagagacttagtcatgcagaagagtttcacacaacaggtgggcttttaagagtgttgtcaaggagaagatgcaaatgccttaattagtttggacagctcttttaagtgtaaagaaaaacatgtctactggtggagatgggctttgcaacacaacagacctgtgtgtgcgattttgatcttaggcaactgaaaagcaagtaacgctccctttctattacctgaagcttctgcttatggagttttgaagttctccaggatggtttttctatttctctgagcactgaagtggctaatgccatggcagatgtcatacctaatgctgcagaggcagagcataaggtagggaggattttgtaggaaccttctgatgggaatccagagagcaaagcctgggacatgaagctctcaataaggaaatgggaaaggaagagtccatggttttacttttaacaaagtagggaattgcttttgcagattagataatatgtgaggattgtggcaatagaagaggtatcttgtgtttgtaataaatgcattatttggggggttacaaaataaaatcccaaaagaggagaagataattaactttcttatgagaggttacctaattttgactgagttgaaaggaagaaaaattaaaggattttaaaggattgaatctctctttctgtctcatttgctttctctctttttaaaatgaaatggttggcagagttggaattttggaaaatagggtcatgaatatttgttgatgaaaacagtcatgcttagtagctttgaggggactccctatagacagacttgattcctagttctagttttcacagctggttgcagttgtttggatgacgataagaatcagggatacttggttctgtatttggaaaaaatgaaaccagactgcttaaaaatttgactggaaaaaggctactgggtatggggttcttttggactatgctgactgcttaacaagggatcctggtttgtcttgtgtcacattaaaatcccatgtctcattgaaatagtggttaaatgaggttgcatgagttttcagttgagaactaaaaaataacatattttgtttacataatgctagtttttgctttattcttatgtttatattagaaatgagtaatttagtcccagagaaattacacgtggggctttctgccaagacccagtgccaaacatgagttttgtgattaaagtatccaatattaacctttgcttgacaaaaaccaagataagatgattttttaaaaaaacttagatgatctgaaaagaaagcattataacaaaaatgtatgagctaggaaaagctgagagttactaaattgggctttgaatggtgtagatgtaactttgtgtaaaaatacatgagtttcatttctcttggtattggaggaatacagataaagatgattgagattaatactaagcctccttatttattgttttatttgattagttcccttgggtggtgggatttactgtgaggcagatactttgtttcattcttgtttttcatctttgggcttcatattcaaatgccacgtacctgtagaatgttagctacagaaaatttttttaaaggtgatattcatttattaattcaacaaatgtttcttgagcacctactctgagccaggtactataccaggcattgtcattgtcttctgggagtgcgcagtcttgaggacgcaatagacctatggataagtaattacagtacagcagaatcagtgctataataaaagcagagtggggaattataaaccttgccctagaaaggaacccttcacaaagaagacgatgtaacctgtttaaggattgatatggtttggctctgtccccacccaaatctcatcttgaattgtaactcccacaattcccatgtgtggtaggaggaacctagtgggaagtaattgaatcatgggagtgagtctttcccatgctgttctcatgatagtgaataaatctcacgagatctgatggctttaaaaatggtactttccctgcataagctctctctgcctgctgccatccatgtaagatgtgacttgcttctccttgccttccaccatgattgtgaggcctccccagccatgtggaactgttagtccattaaacctctttcttttgtacattgcccagtcttgggtatatctttatcagcaacgtgagaatggactaatataaggatgaataggcatttggtaggtagagaagattaccctaggcatagggaagaatcttcacagagctgtgaactcaggctgttccagacaagagtgagcacatcacatgaggctgaagggttggagaaggactagagtgaaagagtatggaagcacaactgggctatagcacaacattttataggatgttactgagcatggacttcattttctaggcactgggaaactattgggagcttataggtaacaaatgactcagattggttttaagatgattctgttggtggtatagaaaatgtattgcaagcagggaaatgttttaaggaggctgttggaaatggtacaggcaaaaggggatgaagatgtcatctaaagcagtgactttggggttgaggaggtggcagaggttttgagtgagggtgaagaggcagaatgggttgacagctgattagagaggacgggaaatgtagaggagagtcctgaggttcctagtgtaggcagctgagtggagcatgaggccagatatggagtcagccagttttaccagtcgaagcagcatatttcaggtggcagtgggatagggtgggtgtagaatcacgggtttttcttttggacctataactaagctatattttagcttgtggacatgcagttcttattatatggagtgagctgagtcatagcaagtgctgtgagttttgattttagctggcctctaattaggcagaacaggaaaactctattttagttgttggattaaatatttttccacctcatgatctagaggtagaggtctctgactttaaaaatagctatttactagccaggcatggtggctcccacctgtaatctcagctacttggaaggccaaggccagaggatcatttgagtttcaggagcttgagaaaagcctgggtgaaataatgatgtagtgagatcccatctcaaaaacaaaaacaaaaacaaaaacaaaaacaaaaacactgatttactgagtgatagctctgtacctgatgctgtgcttaagaggtactgtgttactagttactagttactagtattttacaagggagaaaaagggtacttatagaggtttatgaatttgtcaaaagtggtgaagatgggagcaagacagttctgtattatatgtaagcattttgttatatgtgagttttgaaaaaaggtaacttttgtaagaaagcaggtgaaaaaatgaaaagattctattttaacttcagcagagaagtggttaggtgctttgcttcttatttggtgatctaggttgattattataacttttctgaccatatgggggaaaataaagcttgatttacaatgctgagaatttgtactacctaataactcactaacttttcaggaaaggatatagtttgagtagctttcagaattataaagaaagaattggacctcttaaaaacctgtgctctcataaagaatactttttcattctgttttatttgtgcaacaatcagatttctgtggctaggttaatagtgttttataggcttttctgggtaaaataaatttttctgttggactgagggcaaaatggaaacagacctagcctaccaaactgtaaaagtcaagcctccacatgttaaaggtgattagccagtaatttaactgctttttaaaacacaaatcaatagtcctgttattgcagaatgagaacagaatacagagtcctaaaatgtgtcatccactatggtcagtgtaaactaaaaaaattctggcaggaaaatgaaacataaacaagagaaaaaggagtcaataaaaatagaccctaagaagacacagctgtgggaatagcaaatgctttaaaacagctactattaatttgttagaggaactaaggattttgtcataaggagtgaacaaatggaaaatctcaaatgagtaatgaaaagtttacaaaagggccagatagaaactctggaattgaaaagtaaaatatctaaaatagaaaattttgcaatatgggcctgacagcaaattgaagaagaaagaagaaaaggccagtgaatgtgaaaatggatcaatagatattactccagttgaacaatgtagaagaaataaaaagaattaacagagccccatatgggacacatcaagcaatataagatacatgtgattgcagtcccagaaagagacaagaaaaagactggcacatgaaacaatattttaacaaataatggataaaaatttcccaaatttggtgaaaaatattaacttgattcaagaacctttgcaaaccataagtgggagacatctaaagaaaactacacttttgttttttaggcaaatcatagtcaaaatgctgaaagtcaaagcaatgaggtaatcatgacaacagtgagaaaaacagtccattatatacacagcaatgatgaatattcactaacttatcagaaataatggaaaggaggaggcaatgggaatgacttgttttaagtggtgaaagaaaagagcaatctgtcaacccagaactctatatccaggagagatacaccatggacatgaaaacaagatgttttgcttacttggtttgggaacctctgagttacacaaagctaagtagatttctgtactgtatgacttctcagtaatagagaagttctaagaagaggatgtcacattcactgatatccaagttttttttttgaccataaatcctttattcacagaatgtctcaggggattcattttatttgtaaaacacgtctggaaatactaagcttcgggaatggaatttgatatttattcttcatttttattttcatgatattgccaggatgaagtgattttggaaaataattagcaatgtatctgtttgcatctgtaataatgaaaatgtgacgttttacctacattgacttttctttcttctaataacactttcagagttgaatggctttgggctgttgccaggtgacatactttccagcaggcctaatggttcagtcttgccttgttggactatttagatatagatgaaaatagaactcccacctagagttttcaatgcatattttatgagtataatagtgccaggaatataggttgaattggattacaataaaatcattatcttttacgcctctgtcttgtgagtatttatgtgtactcttacatgtagtttatacatgagtgttacaaattaatgctaccaaaagcaagttgtaaaagtagtccagaattacattgtaaatgacttaagccatctaattaaaataaaatttcaatgtcttgaaataattcagtgaaggattagtgacttaaatttcatcgctgctctgaacatgaccttctctttgaatatattagaaaatggagcttaagagatcatcatttaaaaggtttattgtgaaatttttttctttccatcccctattcctaaatctagtcataaccccctagatgtctaacatatttcctttccacagcagagtttgaaatctctacatagccaacattgaggctctcaggctcccaccgcattagtgttgattgacacggggggttcggctttgtcttcttgtctgtggctgtaaagggcaaggtgggcattcctctctctgtgtttttcccttactcgtttcctccaggaatttgtgagtctcagtctcttttccctctcaaccaaaggcttccaaccaatgactataaacttcttctacagcagtggttctctaattggtcctcagttcttcagcatctgtcacttggaaacttgtaataaatgcaaattcttggcccctcccgctagcttactaaatctgaaactctgggagtgcagcccagcaatctgtgctttaacaagctttcccagagattctgaggctctatgaagtttgagaacttgttctctatagtaagaaaaaacttaaatcatttttttctcatccttttggttatttgacaacaaaggtaaagcagaatctaagagttcttggtggtgatagtagcggggtgttgaataaaccacttttcaaattaagtgatgtattttaaatagtaacaataattagtggtaatatctttacaatattcttgaggtcattactaatgctattgctgtgttactgtgaggaaacaggtttaggaaagaaggtagccaaagtcaaggtgtttagtagtggagccttgatgatgatgctggtttgaccaatactagcacccatgctgcagcccacttggtaatgctctctgagatgcctggtaatgcctgtctcctcttatccctgcccatgtcttccctgtgaggccagagacttactcgtttctttttaaaaatgcaagaggtggagtgaaagttcgtgtctttgtagattaactctggcctttcttactcatttgtagactatcccacctcccaaactagtagccaaagctaccttgatcaaggagagggaatgctgtactttattcgtaaggcaaacaaatgtttatggcctcttttcttataagtactgtacgctaatcgattgcgctgctagagccactatggcctcttttctttcaaaagtttctctctttctggaagtagtgaattcactgaccaatttatctttgggctctggcctgcggtttttgaaactttccaagatcaactgagcgatgatatggtttggcattttaaactgcgaatatagtataaagttggatgattttgagagcaattcatgctcgaatgaagtctttatcccactgagttatggtctccaacccaacccctttaaaaaactttgttggatgattagaggcaggctttccaattccactcatgacaattgagggattcatttgcactccaagatatatttattttcttgaccaccaaggaaatataatgttttaaagaagtaaggcaattcatattaaatggaaaggaactatctaaattgaaacttaatggggtcatattttaacataaaagtgaaaacttaaagtaaccttcagagttactaattagtttgatactagctccactttttctaccatgtagatttcatttagtagaggagagtaaaagaagaacattaattaaaattggaatgattaattttgttatgtgtctgtgtaaattaattccagtgtcagtataaattaactccagtgttagtaattccatagacttcctttccatggtttgcttcaataattgagaatttatcagtcattctgatatcagaattcaaataagtatttatacgtgcttgtgtgtatggggcgggtaaaggacatgaaaatgtatagatatttaagaaatgtcacttttactccaatttcttatttatgttaggatagccttcaattttaagcaaaacacctatttagaatgtttctccttcatctccttctctacctaggtccctttcccttttctcacaccacttataattagaagcaagtgaacagctttgcacttggcagagattaaaaaacctttttttttctgttgtacaaggtgatttttgtgcaaacaattgctatctcttccatcaaaacagtgttctctctagagaataatgcttgttaggtcagtttggtgtggcaatatttataggggatacgcttgaatgactgaaaattgtaagtggagatgttcacataacatttgtttgcttctcttgtccaccaaagtaattcataactgtagatatctttttatgtgttgactgcctcgttctacaacactgacaggtgttggtgactgcatattttttcctaattccttgaacatattcacagaaagaataaagtttagtttgggtttctattgttattctctggatgcaaaaagaattcctagctcccaaaatgggtaattttcttgattactcatgatctatcatgtagttcctctgtttgttttaatttcttaatatggagtaatattttacaagatttccaaaatacttagatcctcatctatattagaagtcagtgtgtgtgtgtgtgtgtgtgtgtgtgtgtgtgtgtgtatgtgtgtgtaaaggagaaggccgcatgctaggctttgcgggacacactaccctgatgttgtagtatgaaatagctatctataaacaacacatgagcaagtgagtgtggctgcatttacataaacctttaatatataaagaggtattgtgctggtttggaactgggtatagtttgcctaccctgctctgtgataattactgtggctttatctgtcttctgtaacccatcgtcttccacatcaccctcctggcctcttccttctacctggtgatagtcgcctgctttcttcttcttcatttttcctcaagttatgctctccacctttgcatgctttcttatctgctatctctctgctcttccttgaagattcctttgtaagatgtgaaaatgacctggtgacagcctctttccccactgataaccagggtttattcagttgttctgactgtccagactgggctgctcctttctcctttaccatttcaggaaagtccctcctgaaatttcattcccagcagaaaacggtgaccttctcagaagaaggtggctttgctcctttaaagtgggagaaccgtctttgtgaagctgcgactgaccactctatctggaaagggatgcctaactctccaaatctcttgcaagttttttgacctgccatcgtgaggtggcccctgttcctccctcttcttccttctgttcctcacttttctttgggggtgagtttatgttaaggagacttctgtgcttaaaagagggcctctttcttaaaagtttgtacctgaattgaccccatgggtgactgtctaaaggtaacatgttttttttcaaaagccaaaaaccattgctaatatggtcatagagtaagtcgttggtagacttgtatgctcatcgagcctcaacagatcatcttcgggtgatgtgctgcctcacatctcagggaatcttgttccaagataatattcatacccctttcttcaaaatacaggctttggttttccactccattgaagaactgctgaagaataaatgtcttcatatgttttgccaactttgccacaagctgctttttgcgtccagctggccataggtcttttttattccctcctgcctggccccccgtcccgagatgcctggaagccatcatgttgaatctctttccatggaggtctgtttggctggcgtttcttcttgcttcagactggaatgccgattagccagtttcttggaatgattttaatctctcatctctccagcccatccatttgaagtaactaataggaccacaatgtcactgcatgagctcaccctttccttgctcaagaacaacgataatacttgtcagtgattgcaacagtggaggacagtgttggtgccagcgttccagtgactatttcaaggattaattttagtgtttctagaaagaagtagttcaaaagtcaggaaaaataaatgaaaataaatcttaaacagatttctaatagaaaaaaaaaacacataaacatattgcaaatcacccatctagttaccattcgctctcttgtgtcctttccctttctcgtgtctccttggaagtcaccaccttctgaggtcttagtcaacagacttcagactcttcctgctgttttgctcccttgagtgcaaactttcaggaccacagcctgtgggcagctcctctgctctgcctcaggctctgagtagagtagctgtggttttgattgatttctcctcctgaatctgccttacttttccttttctccagtggagagactcactgcttctgagagctcctcccgccacaggggtcaaacttttgatggcttttgaggggctggagggagagagctgtacttgtaggaactgagtggtgaagaggagcagagaagcctagagagagggtgggagagaggaggaaacactggagagggacaagaaaggggacaaaaagctgttgatcagaggctgagataatagtatcacaactgttatttcagtactcaaaataaagcatgatgcatttgattaccaggatttagaaaactggacttgtagtcactaatgatgtaagaattgctattaatatttatgaagggagtttttatatttaatatttagcatcaggcaccatgctaggtgctctgaaaacgccatggtctttcacaataggtccttgtttgatggtcagtggctatcagaaactccagacttacctactacttacttacctaacctcctgttagctttctcttcagttaaagagatgggtatatttctagtaggcaaatggccccccattctcaccctaatacctgaaatttgagaacattccatacattagtttcccttactgctctaataaattatcacacatttattggcttaaaatgatacagatttatgattttactgattttgaagtcagaagccccaaatggatcttactgggctgaaatcaaggtgttgttagggctgagttacttctggaggcctagggaagatgctgttttcttgcctttttaagctaccagaagtttccctgctcacattcctaggcttgtggcccctttctgtattcaaaggcacttgcatctgtctcacatggcatcactatgagactgacttgtcttcttccctcttctacatttaaaagacccttgaattacactggacccacctggctaacccactataatgcccatactttaaggaattaacaactttaattgaccagctttaaatcctatacctgaagtctagctgatcttctttttgtatttctttcagggccctccatggttttaggttttatttgtcttctctgttttggctcaatgtctctaattcctcttcatttttcaaagttaagttcaagacataacctttcatgaagcgctggctactctggtcaacatgctggcctttccccacagctttgatcatctttggcatatggtgttcaacacatttatcagggattatacattattttctgggtattttctgtacgtcttagccttccaagtcatatgcttcttgagactaaggatatttttgtgcctatcctaacatgatgcattgttgtaaataataaatgtttgttgattgactggctaaaaacaattctgtaaaaataactgagacacatgctggtagtagaggtttcctcgttgtataataactatagaaaatctagcacaaggctgggtgtggtggctcacacctgtaatcccagaactttgggaggctgaggtgagtggatcacctgaggtcaggagttccagaccaacctggccaacatggtgaagcccaatctctactaaaaatacaaaaattagtcaggcgtggtggtgggtgcctgtaatcccagctacctgggagactgaggcaagagaatcgcttgaacccgggaggtggaggttgcagtgagccaagatcgctccactgcactccagcctgggtgatagagtgagactccatttcaaaaaaaaaaaaaaaaaaatctagcacactgactactttcagttacctggatttcaagacccttcatttctatacctcttttttcatcttggtctcccagccccatccccaccctgcccatgtacatctagaactattaagtagttcaaaagaccttatgatgacatgccagctggcctttagcttctaaatgttctcatattacaaaatatattattcctatcctgttgttctctttgcacatctaaaacctctccagctttgaacaagtaatccaatttgaataattcatattatattatgaaagacgtaaggcaattttaaccattctgattttttattttctaacaaagatcttatttaaaaaaattaaactaaggaatttatgtgatttatgaaaacatccgctgccttctcctcttgcgctttctgctaataagagtctcttggcacttcccattgaacagtttacagctctgctttattgagaaatggaacacacacttgttcacttgttttagtggccatactatgatatggaaaagcagacttgagaaacacatcctccagtctcaactcggagtgactttctgttgctttagtttgcatttcatatctcatatactttcttcggcagtttctttcctataagtgtgaatacacacacacatacacatgcatgtaaatatatatatatatatatatatatatatatatatatttatgtgtgtgtgtgtatatatattcatttttggtcagtcaacaaacattattaacaacaatgcatcatattggaatgtgtgtatatatatatatgtatgtatacatacatagcacacacatgcatacacacacacacacaaattgatgtgattttgttgagtggagatgggtgaggttggaaaagggagaggaacgttaggtgacattatcttcctatctctgatttccttctctgcatacgtggttgaggagtgctatagtttaaatgtgtcccctccaaaattcagatgttgaaacttaatggccaaagtgatgaccttaagagagacttttttttttttttttttttttttttgagatggagtcttgctttgtcacccaggctagagtacagtggcacgatctcggctcactgcaggctctgcctcacaggttcaggccattctcctgcctcaacctcccgagtagctgggactacaggtgcccgtcaccacacccagctaatttttatttttttgtgtgtttttagtagagatggggtttcactgtgttagccaggatggtcttgatctcctgacttcatgatctgactgtctcggcctcccagagtgctgggattacaggcgtgagccactgcacccggccaagagggacctttaagaggtggttaagtcatcagggctcctcccctcttgaatggaatgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacggtgagaaaatcaatttctgtttttttttataaattatctactctgtggtatttcgttatagcagcacaaacagattaagacaaggaggtaaaagaagaggagtgggaagtaggtttggtaaaatgccatcacacatctggactattgagacacatccatggcaacatgaatgacagaaacctgattatgggagagaactgaccaaagtttgggaactccagcatagctgagagagtgttcttctgttcttctgaagtagctccaagtgactccaaagccacacacatttggttttagccttgagtctgctactgtatcagtggagtgatcttggacagatgtctcagagtgcctgggctctatcgtcgtcacttgtaaaatggggctgatagtacttgccttgaaggattagagagagcacacgttaaatgcctgttactgcttgatattaagtaagtgggagacattgtttctgtgacatagtcatgtgatggtagattcccagaataactttatgtgcaaagggatctgcttcaaaggggatggggcaattgactgtgaaaattactatagaagcccaattgtggtgcttggatgaatcccccatagactaaagggacagcttgggtttgagttcactggatgaggggctgtgtgctttacttgactagacctaatctgcacctgagttgacctcatggattgcattggctgctagtgagctgtgagtgttttctgagatctcggtggcctctaatcccatctccaggtggacagaggcgggctgaagcacagatgtgttggccactgttcctggccctgggcggttaggcttcagctgggacactggctggggcgagaacttagcagctcatgtggctgtggttgcttcatggctggacatgccttgccattaaaaaagtaagaggagttgactgatttctgtaattgtcttcttaggaggtattgtggaaacttttacatttaataaatactgtttagtgttaaataaagaaacaaatcaagagaaatgagtaatatattttctatacttatattctatattttatattgtgtttatatatacacaaacaagtatatatactctataaacattatatacatatgtgtgtgtgtgtataaaatatgtccctttggaaattatagtgtgctgtattttgaaaagtagactgtgatttgatatgtaaaattaaaaaactaacttctttttcattcccagtaactcagacaaagcttcacaagctggtactacaaagacccaaaggcggcagtaaattcctcttttgatttaaatcccattagggtccacacttatgaaacaaatgttgaaaatcctatagctgacaaagcagatgacttaagggggctttataccaaagaggcttataggagttattcacagaagaacttccagttgtaaaagagataaacaagctttggatctgagtggtgtttaatctgagtgtgcataagggccaagaagggctcatattgcaaaacttaccaaagaatctcagcactttaaaaccttagtggtcctggcttcactgaccaaagtttattattctattcagtcagtctctgtctctccctctctttctttctctctcgtttctttctttctaatggtgaagtgcaatatggtatctgcttttggcaccaaattacagttctgaacacctttatttacccatgtatacagctaaaaacttcttgacaacatattagaaacaattactctcttttagattggccccgtttcccaggccaaggttaaacattacaattagagaagtgtataagcaatggattaaaatgtcaggaaaaatatcaaactgggacagttgttttacttcataaagtcttagcagagctctctcccagcatgccttgtgtctttgtaatagtcttaatatggaccatatgtgcaaatagaagaactaaataaaacttaatagatcacctgagtcaagttattgaataaaacatctgctctaaagccaagttcaaatgtcctctttgtagaatcagcatgtgatgatgtagggtacatgaagcaaagaggacttcttacttttgaaattttgtaggtgaaacccagctccaccaggaaagggagaagacgggtgggagatgagagacagaaccatctgaaagcctgtggatttctgacatttgagttgcctgtatggtagaacattttgatataaggaaagttatataacagtgtttaaaatcactattaacattgctttatttttatttttctgagacagggtctcattctgttgttcaggctggagtgcagtagcacaatcacagctcactgcagcctcaacttcctgggctcaggcgatccttccactcagcattccaggtagctggaactacaggcatgcaccaccatacctggctaatttttcatatatttttttgtagagatgcggtttcgtcttgttgcccaggcttatcttgaactcctagaacattgcttttaaacattttatttttggggggcaatgcaagaacatccaattgcaatccagttacaagttggagtgaaaataaacatgatgcatggcatcaaaaaaatgcattgcaatgtggagtttgggaggccacagtagcttcaaggtgaggttgctggcaacattctgagagaaggtggtactgctggagaaagtgtgtgctctagagccaagggtggactttattgccggtcatttattccttcattcacttactcacaaattgttactcagctcccactaaaagtcacagtctttactgcacacatagacttagtgatagctccaagctgtcctagatgacattgggactgggttggaaagggaagtcagcagaccgtgtctccattatctaatttgatgagactccaagccacagccttccatatctcaaaggcatttctttgagataaggtatatttctcacaccaggtcaggtagagaaccaacaaggaatatgttctctcctcagggagaactgtatttttcacaggcttcaaaactcctgtgttgcttaagctagaagtatctcttatggtgggattttaggaacaaatggtatttttgtggataaaaggatattttcattaacctctaatatcatttcaggaaaacaactaccgacatggttttagcagatacctttttgtttaaatctgaaagagtgttaaattatctatccacatatgtttctggatgtttataaactacacatatatacacacaaaaggaggatgtgtccattaaaagacacatttaaagcagaaaatttatccatacactcacatccaaagctatttgttaaaactcttcagtatattgccattcaacctataatttctcaccatgcttttaaaaaatgtaaatttatatatttgcaggatatatatttccacacacgtatattacataatggtaaaatcaatcaaattctttttgtgattatgttatctgcttaaatatatgtgaggcttgacatgaaagtaaatataaatataaattgttattaccagttggattgttctagatgtaatgattatctttgattttaggatacttagtttacagaatgtcccttttgtgaattaacaattgtaacagaaaatgactgctcctaatagaaatccttttcatagtcatatgaacaagtagggacacaagttctcatttaatgaaaagtagagatgaataattgcttgtatcggttttatttgctccacaaagatcccatcaaaattgcaggttctttatctcgattctcttggatttggtgtgttgacctttattctcacgcatttgccttttggttgcaggatggctgctgcaactccagtcacaatacacttgtccctcagtatccctggggaatcgattcaggacctcttgtgaataccaaaatctacagatagtcaagaccgtggtatgaaatggcatggtatttgcatacaactgatgcacaccctcctgtatattttccatcatctctagattacttacaatacctaatatagtgtaaatgctatataaatcgttgttaccctgtgttggttgggagataatgacaagaaaaaagtctgtacctgttcagtacacgtgcaattttttccccagtacttttgatctctggttgcttgaatccactgatgcagaacccacaggtacagagggccaactatatttatgtttagggatgaagaaagagcaaggtgcagtacccttatgagggaaataaaactttctctaggaggtcccagtagaattctatctgcacctgtttgatggtgggcttgccagagttctgtagcaagcttaccaagcctcttgagcatttccagcctctgaagaggaaggctgaggttaagggaatggataattgctacccctgaaaggtctgtaacttcagtaaattgtgatagctggtactgatctgctgtcactggaaatagttgagatgcatagacataagtaatttgacccaatgctgtccattagaactatctgtgatgatgaaaatgttcaataatccgcactgttcaatatagtggccactggccataggtgactaatgagcacttgaaacgtgcctattgtgactgaagtgcagattttaaaatttagctttagtaaatttaaatttaagtagtcatatgttgcaaggctagtggctatcatattaggcaatataagtttgatcatctgagttatcgaggagaggaaggttgacatttgggaggtcaagtccttttatgattatttcattaaaaaatcaaaatatcaaaatgttatttccttgtgcatatgtgtttagtttgcgtttatttgttttttcttcacaaagtcaaccagaagaacaatttctctgcctaaacacagacttcttgaaaattttgcatggagattgctcttttatagttgtgaaagtttgacactacagaattttttaaaaaaattctaaacaccccattttctttcacagtactatttcagtggcagtagaacaaaatgacttttaaagggggtcatctaacagtttacctcctttctgtctgctgttgtataaactgtaaatgcatttttccgtcatgaaatggttcaatctctgaaatgtgtgagtttattttggatttaattttatttctggcaagtttcatgagaaagaaatatcagaggagatcagggaactttcagtatcacgagtccttccaggctctgatttcctcgtacacttgggtgttggtgaacattctggcagtgctctttggccaaagctctgatggaatgaacatggccaagctggaatagtacagatctcaaatgtgctaataggaaacatcactggagcttggaagtccagcatcttgggtggtgtcccatgggtttgggaggtgtcatcctgtgctaagttttgtcaggagatatgacatcaacaagtcaatttatcttccagttagaatgttcattttactgctggattcagcaacatcttttgctttatgtgatattcagaacaaaagccatgaaatgctctagtgggaaattctgtacctttaaaagcaactgttaaaccaattctggaaagttgggaagtgtgagaagtgcttacttttggactgggccacagatctaggtgggttgtggatactgctgcctaagtgtcagactcatactactcaatgaaccctgaagggttggctcaccaattaaaacaagaactaagatttgcatcagcatcctggctggaaacagatggcatactcaaagatcaactgaagtgactttaagaggagactatttacagatgtgtggctaggattaagggaattaataggagataatgaagcactgaaggccagcataaatgggacattcttatggtctctcattggcatagtttgcctatgtccccaaccagatgtcatcctgaactgtagttcccgtaatccccacgatccccacgtgttctgggatggacccagtgggagataacagaatcatggggctggttacctccatgctgttctcatgatagtgagttagttctcacgagatctgatggttttatagggaacttttccctcttggctcttattcctgtccttgctgtcaccatgcgaagaaggacctgtttgcttcccctgccaccatgattgtaagtttcctgaggcctccccagacatgctaaactgtgagtcaattaatcctctttcctttataaattacccagtcccatgtatgtctttattagcagcatgggaagggactaatccactcatcctgaaaagggttcagtagagccttggttttggaagagaggccaccaaagaggagctatgtccctgggtgcaggagaagcatccaagtgaatacaccctggccctggagtaggggtgggagaataaataacacccttatgtctttctccagttgcttctttgtttttcccatgtctcctattgtctggcacctctcagaagcctgagagcaagtgaaggatccaatccatagaggatggagaatgacccttgagggtcaaggagaataacccatgcattactgtaatttatccggtgcttctctgtgggtacaggctgctaaatacttccgtacacattagctaatttcattcccactacaatctccattttactaatgagaagactgaagctcagggaagttatgcaaatttcctcgaatctagctgctggttaatcatcaagtcagtagcctgaactgtcctcagactcccagtccaagctcttacctttatggtatgagaaggatgtggagatttatcagaagtagagggaatatagaaactaaccttatagtatcaattatagtcatagtaatgggaagaatacccctgcctgacatttcagagacattatctcacttgaatctcacaatgtttttgggagttaaaaaggttaggtattgttaactttaccttacagatgaaaaacagcaaaggttcaggccaaatgacttgctacaaaacagtatctcagggctggcatttgaatataggttttttttttttttttattctgaatccatcagtcagtcaagtataccacattgctaattagaaaatgctggcagcaggacagtttaattaaattaagccaaaaccccaaaccaaatggaaaacaaaagccatgtttatgtagatattctggtggagtactaatatctgttttaccttatggatcgctatttttaattttgtccattttgaaaagcctaccaacaatgacggtccattgtaaaagaagtgaataaataatagatgactcaaaaataagaggaaggaaaatgtttgaataaatgggtagcaatttcttaaaaaagttaattaaaaatttatataatataccaaataccagaattaattccagatacagagttaaatgtaaatgcttaatagatggagagacacccaaaagataatgtgaaggaaacagccgacattgtttggtctgtgtttcctggacaccagttgcagtgtaggggctcagaaagagttttcttttcttctggtagatacccaataatggaattgctgggttgaatggtagttctagttttagttctttgacgaatctccaaactgctttccacaggggctgaactaatttacattcccaacaacagtgtataaacattcccttttctttgcatcatcgccaacattggttattttttgactttttaataatagctattctgaccttggaatactacatagccatacaaatgaatgaaatcctgtcctttgtagcaacatggatgcagctggaagccattatcctaagtgaattaatgcagaaacagaaaatcaaataccacatgttatcacttataaatgggaactaaataatgggtacatatggacataaaggtggaaacagtagagactggggtcttcaaaagccaggagggaggaaggggatcaagggttgaaaaagtaccgattgggtactatgtccactatttgggcgatgtgtccgctagaaacccaaacctcagcattatgcaacatagccatgtaacaaacctgaataggtatcccctgaatctaaaatcaaagaaaaatagagagtgtttgtccatctaacacttgccacagctttagctggaggttactattggcttcacagatgagaaaaccaaggtgcagaatcctgtctagagccccatggcagacagtgttgtagcccagtaggagccttcactgttctgactccagactccacatcgctaaccaccctgtgctcttagaataatttccatcctgactgttagaatacagtgaaggaagaaattagcactttgttttatagacttgttagatttccataaggtgaatagtgtagctgaaagcaaataataaaagacaccgggaaaatatttgcattgaatatgacagtcaaagggttaaactttgtaacaaaggttttaaccaatgcataagaaacaccatgttgataaatggacaaaaggatatgaataaacattagaatatgcttagtaaacacatttgagaaaaattaagcttattaataataaaagaaatgcagattaaaataatgatgagatagcattttgcatatttcaaatggataattttggggctttttggttgttttttaggctaatactagggaaattactaggcccttggtatggtggcaatggaatttgaacagccactttggaaaagcaatttggccacaattttaaggaatcataaaatttctacatactttgacccagccatcccactcctgggaatttgtcctgaggcaattattaaaaagacaacgaaagccatgtgtaggaaaaagttaactgcaatagtatttataatagtaaaaattggaagtcacctaaaggtctcataacaggaagtgatttggtaaattatggttctgtgtattagggttctccagagaaacagaaccaatagggtacatgtgtgtgtgtgtgtgtgtgtgtgtgtgtgtgtgtgtttgtgtgtgaagagactttttaaaattaggaattggcttatgtgattttggaggctgagaaatccggacccagcagagctgatggtgtaggttccttagaagtcctagttttaagtcaggagaagactgatgtctaaggttcaaagacagtcaggtggagacagtaattctttcctactcaaccttgcattctattcatgccttcaacaggttgggtgaggcttgtgtaccctggggaggacaacctgcttcactcaattttactgactctaatattagtctcatctagaagcaccctcatagacatgagcaatgtttaaccaaacatctgggcaccctgtggtccagtcaagttgacacataaaattaactcttacagtctgtgtaaccagcaaagtaattataaaagccacatagtagtatgaaatactaatgatgttaattgaaaaagggaagaaaaattatatttatactatgcttttaattgcaaacatgtccacatgtagattggtattaagagtaagtacggaaaaataaaaataacaatagtgaccataacaggatggggaggttatggctcatgtagacccgcgaacacatgggctttttgtggcactggcatgtgattcagggtaagtggagttctgggtgcatgaaggggagtgttccaagatcaggttgaatagaagttagaggtaagtaaggaaaattgtttgatgccatcctaaagagtttgaactttgttcttatagacattggaaagccattgaaaatgttataagtaaatttatatttggggaattctgacagcactgaaggcttccgagtgggagaggggtgcttaggaggactttgtaatggtctaggcaggaagtgagaacctcaactagtaatggcaatgtggtgatggagaggagtggagttgcttgacaggaatgtcagaggggggatccccggcatttgccaagtgctcagatgtggacatgtgggaaaggaaggagggaagcaggactgccactcttttggcttggatggatgtggttaagaggaatggggagggaggcaacatgccaggttccgtgttgagtttactgggagtcaggtcatcaagaggcatcctgtgtttcttccaagagacagttggaatataggtcttttccttgggagagagggaatggtggtggaacttgagcatgattatctgtggccgtagatgaaattgggagagtgtgggatgcctagggaaactgaatatcaggaggaaagaagatgactgagggcagtaccgtgggggaaatctaaggtttaaagatggaaagaggcattgatgaacagctggggaaggagtagtttgaggtagatgtgcagatggaatgaagagaaggtctcaagaagagggtggagccaaagagggctgcagatttagaaggctaaagtctttaggtggctttggatagcctgttgtatcttggaccatgcaggttacagtggagcatggagtggggacagaagtggaggaaggaaccagggaacatggagtgagaagctaaaggaaagtgatgcagtagatacatggctctaaagtactcaggactttcagaggcttaaacatagggtgaccaactatcccactatgcctgatactaagggcattccctggatgtggacctttcattccccaaattaggaaagtcttgggcataccaagacaagttggccaccctactcaaaagtatgtaagctaacatatctgttctctaagaggttaaagctggatggggataccagatgtatgtacgtgatgcagttaaacagcaatacaagggggcaagtctacactgatcggccaattcagtgggacagacagtttgggaatgtttttgaaaatatttatgggttaaagcaatttggtgaaattttggcaaaaataagctgaattttttttaaattttttttttcactaaaatatcaagacagaatagcacaataaaactgtagtgaataaagcactggtataaacattgtcagttttaagctaaatagctttcttattgagttttctaattactgtttgatttatttagttttaattttactccaaagggaataaaaacctgtaacaacattaatttgcattaatgcggaggtggagtgctatttgatacgggcaaacactgagtttacagaagttcaatgctaatagcccctccatcctagaaaagacccaggttgtgcaggggggccgactgaactcatagaatcacctccttgtttgccaggctgggccctgcctgctgccatccctgggtgttggagttcctacccgtggttcagtttcctggcacaggctcccaatcacattgcctattggttcactggagagcatgggccgttggagtcctgacgtccaacccatgtgggcttggggccaacttctgggtctctgtgactcattttcctcatcagttgtacagtccttttgtgaaaattaaaagcaatgtttgtgcagtaaggatgcccctccatctggggctctctcacctggctgcttgccacttgctagttctagacaagtcacccaacatttccatgcctcagttttctctgtaaatgaggtttaaagtgtcatgggagcctgggcaacatagtaagactctgtctatacaaaaaataggaaattagatgggcatggtggagtgtacctgtggtcctagctacttgggaggctaaggtgggaggatcactctagctggggagatcgagactgcagtgagccgcagctgtgacactgcactccagcctgagtgacagaatgaggccttgattcaaaaaaaaaaaagagtccccaaaacaaaaggacaaatggtgtcatggaatttacagtcgatcacatatatacagtgcttagctcagtgttcccacatttttattcttagtccctcttcaaccatttactagcatatgaccttagacaagtgtcttccttgctctttatttccttatctacaacaatgacaaaaaaaaaataaaaataaaaggggcttggccaggcacagtggctcatgcctataaacccagtgctttgagaggtccaggtgggaggatcatttgaggccagtagaacttattgagactctgtctctatgaaaaataaaaaaaaattagccaggtgtggtggtgtacacctgtagtcctcctagctacttgggaggctgaggtgggaggatcacttgagcctaggagtttgaagctgcaatgagctatgattgtgccactgcattccagcctgggcaacaaagcgaggctgatatggtttggctgtgtccccacccaaatctcatcttgaactgtcgttcccataatccccacattttgtgggagggacccagtgggaggtgattgaatcatgggggcggtttccttcttgctgctgttctcgtgatagttctcacaacatctgatggttttataaggggcttccccggacttctctctgcacttctccttgctgttgccatgtgaagaaggacatgtttgctgccccttttgccatgattgtaagtttcctgaggcatcctcagccctgtggaactgtgagtcagttaaatctctttcctttacaaaatacccagtctcgcgtctcgggtgtatctttattagcagtgtgagaatggactaatacagtgaccctgtctgtaaagaataaataagtaagtaaataagttaattaaaagggcctgaactaggtaatttgtagagtcttgcccagtttttgaacattgtgttttctgtaccatcaactgaagcttgggctgagggttaatatatgtgtattagtgtggtggcttgagagactggcttcaggagaagatttcaatttagcatatcctgacctttgaaagtgagaatttagttgaggatgaaagactttaagagggtctacaaagaaaggagtatggatcaagattagtctgtctttatgcagatccatacagagggtttctgttgagtaaatcaataaattgggcagagtgtgggcttgtttgcctgcatccctgctacttgtcttctgtttgttaccatagctccttcttccccactctgcagtctggcctgtgtctttggactttgtccatcagtccactccttctttcttccctaaatcccagggctcctaacctggactctgtatatggaatctgctttcagactgagctcatgcactttctctcaaatgctggacatcctgcctatttgcttacctgtcctctgagacctgtctgcaccatcctgcttttgggtgacatttctatcctccaggtaattgctgaccctggttttggcctctatcctgccttgtgctgttgctggcaaagcttcagcttggttccattattgatttctgcaacgtgtgcgggaagagttactctgtgattacgacttgtgcaacttgacagtatatggacaggggttgaatgggcacaaaaagaagtaaaacaagtgaagattgtcagtgatttcttttctatatttcttttgttgtcatgctttttttttttttttttttttttgctcaggaaacaaaattgtagagaagttatttcaagtgataaaaaattcatgaatctatacaaacttatgttgtgaacttttgtattagttcatgttgaatcatttcaatcagctgccatattccagtcactctcacaggccctctttggttcattgaaaaagaattagtactttagtggaggataaaaataataaccggttaatgaaagtaaaggactattacagagatagatatgtataaagattttgggctgcacagccgaggaaacactcagttgtctggagttaggcttggggaggattcccatcagaagtgaccattaggctgaatcttacaggtcattatagatggagagcacagtatagtgaaaggctcagaggaatgaaatatgtgttagaaattgactggtttggggtagttggagggtgcgtgaggagaagattaagcaagaagggtagaactaaggaccatgtttagacctaccttggaatgccatgagaagcagattgtctggtggtgataggaaattcttacaaaatcagaatgaattgactttaagtgactttttaccatgaggaacttgggaaataatgattgttcatttcacattgagtatctctgtattatttgaagcttttggagaccttctttataggactagtaattctggctcctctttgtaaattaccaattatacactgaccttctccaaccagccctgcgtttgagctgggtctcatgttttctgtagcatcctccctgtctacaggtggagccacctgctcctctctcaccctccatctctctccattttctgatcccaagtgagattaatgaatcttgtttacttcacagccagggaaaaggagaggctttgaatgaataatttctgactgaatttcttcttgatgctgttttctctccagaaaggcactatcattaattaaagcaaagtaaacaaagcaaatcctaagcagctgagcttcatattttaaaagacccataaacctcatcagcataaaataaattaaatttggagcttaccaagtgcacactttcattttgatggagtgttctatgctctggatagaatcgtctgaagtcatccaaagctcagacagggctccctgtagatcctggacaaaaatgggctctgtccccagttggctgctccagcaaggaggctaatggaaagtaaaggacactggtagccaattccagcagccttgaatgtggacctctgggccatggttgtatagtgattttatctacttatctatttaaaagtacttgagatgtgtacatttcactgtgtaaattataccccaataaaattctaagtaaacaaaaacagttatctgcttatttaagaaatcttccttctcctttgcttttttttaaaaaaatatatgtatatataaaatgagagttctaaagtgcctttttcaggagagaattttgaaaattaaaaggacagtgacagtaataacatcatttgcagctctgggacagtcactgttttgtattagttttctcttttgaaagtggcataccacgttcttggttttgtttatgggttttatttctggtttatttcctcctcatatgagaagcatatttaagaaatactttgtaaaaacctgtatagttttttttatttttttactttttaagagcttgataactcgaggattactcacatgtgtttttaaaaggttaaaacctaagaccctaatctaccaactctaatttgtagcatctccatcatttttctgctcttttctctgagacatggtcatttagctgctggtcatcatggtggtagtatattcttcttcctgtgagttcttatctatgcagctttctcatcccactgttttggaaaggaaaaccatcagaacacccaaaacaatgatgctggatgttggaggtgagaagcagactgtcagtatcaagctctgaatcgggaggagaaaccttccaatgagtctgagcgtccacttctcctccacagctgtagatgcacgtgcccccgggcatgttgagggggaccacgtggcaagcatcatagttgctgttagctattttaaaaagctgtctttgtagttcattcttctgctgcctaggagtctgccagtggaatcacaaggccaagtattgacagcttcaccttccgagagcccttcttcttaaagccgagtgtctggctatcaagccaggaaggcttgggtcactgagggggacatcctcttctgcaggaaatatgaggttttgctgaactcctcctggtattcagtgatttccagaccacgttctgcagaggtgattctgctgtctcacaaacgattttgattttgattttgattatatttttaaagtatcttttcattagttggaaaccataatacaaggcaacacaaatcgtttactgtgttatgcattacatttgaacaggttggttggtaaaccaccagtacattaattggagatcatgggtaagaatttaattcttttatttactttattctgattttatcataacatttctctgccatatctgtgtacatatttgaacttatgataaaacatattcccgattagatgctaacactgtttgtttttggagtcaagcctacacctgtctatacatacccttttcatgggaactccccatggtggtagtttgagtgctcagttgagtgtaggaacgcccaggtgcacctgcttggtcactgctctgcttatggtcaaggggaattgtgagaataaagaaacatgctgcaacctagtgtattttaagtaagcatttaaaactttcaggcagaactaccctaaacagcaccaaaagataaatgaataaatgatacattcaagaaaatgtattgcaagacatttgactaacaaaggttgtgttctcttaatatgcaatgtgctttcacaatcaatatgaaaaagacaagcaatccagtagaaaaatgggcaaaagactcaaatagagtcacagaaagtaccgattttcaataaacatgcataaaagtgttcagcctcattcagttaataaactgtaaaatataacaatagttagagttcccctgcccaccactcccctctgctgcagacccaactatcgtatcaggcaagtagcagttaaaaagtaggataaagcctatgctgatggatgagggataacaggtgctttcccacattgttgttatttgtgggagtgttaattttctaaatatccatatgtgattagtaaaattgtatcatgatttatcacaacactattgagcctaaggaaaggagagagagagaaaggggggatatgctgttagggaaaaattttggatatatagtaaaaatagaaagtaagctgtaaaatagtacatatggtatgatcacatttatatatatttgtgtgtgtgtgtgtgtgtgtgtatctatataaaaatgaaagaagagtcttcctatgcttacaaatgcattgaaatttctgcagtgagatgtaaaacaaaaacaaaagcaaaataaaacaaatcaacaacagaaaaccctactgatggtggttgactctggggtggcacattgatattcagggcataaagatcaatcttttgtatttcattatatgttcttctatatcactttaattttattttttacagtgaacaggtagatagttagtgaaaagaaaactaactaataaaacagtgctcgattctttctcaatcattctctaataatgtcctaatcttccctcatatctgattctagaatcctgttttttcaaatccaaatacttgtagatttgtttttaattgatgaagccttcaatatcctcaggatctacttcttaagaagtgagtatattttggctgacttgccttgacagctcactggaccctcagcagcagggaagggcagggtggaagaataccatgcttgctccggatgggggatcctctgctccaggctctcggtcaagagcagtggttaggaaaatacccccaagtaagatgacttgagtttagatctttgctctaccacttgctagagttatgctgttgggcaagctactttctcagcctctgttccacactgtaaaacaggactactgatgttaaccacacaaaatggtatgaatgaaaagttatgctacctaacaaacactacttagaagggaatctggaacacagtcctgattatatcagatgttgtcatcctttcatttatgtttgtttatagacatgcccacctctgctccatgtttcggtttccttaactgtaattaaagagagctgaatgggataacagggaaggtcttcttcatgttcaaagtgtaatgatgtaatatttgtatttctgatgcactctgaattaaattctacatagttaaagattatgtagagttgtttgtggtatttgattgtgaatttactgcttcatgtgtttttaatcaagggtccttgggtagcttaaatgaagacaacatattgtatgatttgtgggttcttttctcattgacagaaattatatacatctgtaccaagtcaatgtcacatatctattgtgctgaagactgagaatagaaggaagatataatgtttacctttgagaggcacagggatatatgacttaaagaattttgggaaagggactgatcataaaatggactgttttggtcaacatgttattgactgagaaactgcttggaagaattgtgagcaatttgctattcttgcaaggaaccctagagtttagaatatggaaactacccttccccgaatcaatgcttgttctagctttctgaagtctaggttttgcctttgtatttgactcatatactctgaatttaattttcctaattggaaaaagccaaccttggatgcagatgagtgatgtagacagatgcatccttgaaagaaatgacactcaaaatggctggagagcctggtgcggttgaatgagggttatggttggatggtgcattggatgtggagggcaagggggtgggctgtcctctgtgtgctgggccctatgctctgcctgtttatctaacttaattctcatgaattatcttggaagctgggcattttgccagtgacaaatggaggcttagagggtttaatttccccacctgaagctttaaggtagtaagtcacagagcctggattgaagtccaggcctgacctgttcctcaactcctccatttttctcgctacctctggtctccttggttaactttgttttatttcatgaatcacagagtatattttttaaccccttcctctagcatcattaatttttgttggttacaaaaggggttcaatttgagagtaagtttgaggaactagcttggggtcacgggatggggatggggtgagagggtgcacttcaggtgggtcagccgggacgtgtgggacaggagaatggctggaatctgggggtgggagctcctgccttctgattttgtctcttctacctgccttgctgtgctttgagttcagtaacgaatcctcaattttctcacatgtgaaatggggacaatattacttaattattaactacctattattacctaatgggagtatctgtgcacctcccaaccgcattctaaaccttcagatagcagggataagcacaaggcccagtctttgtcaaagaaaccttttgttatatctttgtgccctactcctatgagcatttgtagagggataccttaacatggaaataacaatctaaaataggacatcagagaggacacttctccaaatccagctgccctttcagctctagatagaacacagagtcctacttcacacttgccttcatttcttagtgtcattctcatgggaatttcctgttcctgctgtatgggaacctgggttgtgtttcctttgacagaatagggaaaaataaagacagtgtgcagcacgtggcagctgtaacatctctctgtgatgaatttctacttactcttggtgaacttcaaaaagttgttctttgaaagggaattataaatttctccagaagaaacttttagatgcctgattcaagggcgttgaggaaaattgtattttaaacatgacttaggaaaaaataagcagaatcctcaaacaggtgttttctctttgtcctatcccctccctccaaaaatgcaaattcagagaaaaagagaccataataaagacctaactttacaaacaaactgagtaggtctggaattgttatacattcaaccagtttgataccacctgtctttgtgcaactgtaaagttaaaactgattttagaagaatgactttgagatcaactaagattctgatttactggagaaagatgcaattactttcagagttgtgtccagccttaagatgagtaagaaattcagtctagtacatacaattttcttaaaattctgattaattggaatttgcgaatatattgtcccaaacatttcactgcaggctactgttggaagggatgtgtatagctgtgttgtgatgctttctttcccagaaactttcttttctgacaacctcatttatccagaacacagccagagtctggcaatagtgggaaggaaagtcctctggaactcagacagctgccacaaagcccatgcatcacattctgtagaagagatagagagctcacacatgtacattaaaaagagaatgtggtgcttttttggctaatggcagagtatatacatttctcaatatcctggagagcatttctccattttagcccagtaacaaaatttatgttcaaatgggtaaaaaatatgaccaataaacagctaaattttactcgtgtagtctgtttaagaaaaccacaagcatgcaaataaagatttttcattcatcactgtcaatttaagacttggcattgggagagatcagctttgcatttagactactgtccccagaacagttaccgttcaaagtgctgaatgaacaagtaagtgaaggacagaagggatataggcatattagatcatgtgggacgccccatttctcagcaacctgcacaaaataggtgttaactgtaattttgaatcaagtaaatgctcctttgctccactctgatttgtgctcaacttaattcccctaaaccagcctctcctatttgtttacacatttctttgtataatctcttttatatatcatcatttcactgtccccaagttgctctccttttctcacttttggggacagaatacaacattgccacagtaaatatttcttcgttgtaaggcagctttatttggaaaggggctttagaaactagtagtcgatgcagtttttagcactgactgtctgcagccacagaaagcttgattaaattttaattaaagtatacttaattaaatcctattggctcaaaataaatggaaaaagtgattaaccgtccttgactgtttttgccaagctttcaccaagctttccctaagcttttaggtgtctcccctggaggggaccgctgctgctggcagataccagagcttgcctggaaggatggagcttttttcctgaactgccaaagttcactgctggcttctagcaccatattggcacatcacattcactcattttcctatgttctcaataaaatatctgcacgtaaagaatttataagacaaaaagctacattctttgaattttatctttacttgtgtagcaaaagatgctgagaaaagtgacttgaagtcttctgactttttccttctaggttgtttttttttttttttttttttttttttttgagacaaaactccagcctgggagctttgtctcccaggctggagtgcagtggcacgatctcagctcactgcaagctccgcctccccggttcaggccattctgctgcctgcctcactctccccagtagctgggactacaggtgcctgccaccatgcccagctaattcttttgtatttttaatagagacggggtttcactgtgttagccacgatggtctcgatctcctgacctcgtgatccacctgcctcggcctcccaaagtgctgggattacaggcgcgagccgccatgcccggccttgccttctaggtttttgtgtcacctccttgcttcctgtttggaatggatcctccccctcctttacatattttacttttttttttttttttaagttcaagtagtcgctgtctgatactaaaccatctcagaggtcatgtcaagagaaagaaaggttaataaacaaaaatttagggaagcgggctttataaaaagtaatgaccttgctcttgggagatattttgtggtttgaaaaaaagtgattatggtgaagattttcaacatgtatgttcattttccttggtaataacctttccttgatagagctatcatggtagcctgctatcaatgtgatcctaagtgcttgaattttgaatgctctggaagatcagaatttctgcccttaagcaattgacaaataaaaatgaacctgagtaggcatggagggactattatacttagcattaaaaataaacttatctaggagagaaaaaagaatagcattccacttacatttgaagtaagggcatctcaaggatgatgaaggatcactatttttcaaagccagaggattccaggctaggttgcagtaattaataggatgtaatatatgaaatggacaaaacatgatcaatgtttaatttccaagtcctaattcaaagttgtgttcctggacaattcggtggctgtcttccatgtggtgattcagggatccaggcttcttccccactgtggttccactgcccctgtggcctcattgactgcacctagttggcacaagtggaaagatagcatgaggaggcacagctacttccttaaagattttgctgataagaggcagatgttctttctgctcacattccattggctagaactcagtcatcatttcatacctaattacaaagtaggtggagaaattgtggcccagatgagtgcccacaaaaaagagaagcagactctggtgaccagccagcatcccagccacagaaactatgtaggtgagggtttgcaagtggttgacccacaacccacatttgccttgctggtatagttcctttggccagcacagtgcttatagaattttaaaactgtagcaagccccaaaagatcaggacattttgcataagatgtggccctctcaggtgtggccttttttgaaacctttgacagtctgacagtgttaatcccccttttttatttgccactctagcctagaattgaacagcaactctaccttcaaagggagcatgcacttcttttgtttgccacagttctggccacttcctgtcaccccccactcttactctccagccatgaaagccaagtatcatttgccatttatcatcttacaccagggctcctctctaattttcattaactgtgagactccaggattggaaaccagagcactgataataccctttctctcccttttcctgtccctctccctcttcccctttctcctcctgcctcctccgtccctctctcattataccacaggagttaagggacacatgttgctttgaaactgaggatgaataaataatagttttgttcgttaagaaatatttcaatgagtttatagaattacaaatgctactggaaggaaagaagacaaagaggaaggcagggagggagggcagaaaggaaagaggagaataaaggaaacagtgaagggaatgccttctatgcttttgagaaaagctcctagatctctgcataaaaatgtggctgccttttgcatgaatatgtttcataatccctattctgtttgatctaaaatttataattgcaaatgggatctttatcctctaaaaccaaagggcagggatatatgtttctttttgagacaattgttacttggattctatacatatccaaggtaaaccagatgggaagtggtaaaagatgcaagataaagtggtgatctaagaaaaaaatgtttcccttctgattgagaaggctgttcatagtgattgatgaagttactgcactagctatgcactgagtttccaggtagtgactgggcacttgctcttctattttgcaacgaagtatcagagaaagctaggatctggaggcaaccagaaatggactcattcattgacctggtaggaagagtcaatgaagccatctcctttacaacccagaggcctgggaaaagcaaactgattatttgtggtgattaaaagagaaaaacaaatcaggaactggagcttgcagttgctttggatccagttattgcttgagttgtaaaatggaggataaattcagggaaagcagtgtctccagctaagggctgtcactgagttaatcctctcatcctgtgtgtaggggtctcaatggcaacacagtgttagcctttttccatttaccgagccgtgttgtcagagccccattgcagtaagtggttgggcatcactgttgtcatgggcatcactgtgctcaaggcatctgaggttctaaaggtgaaggcagtggtttcaatccttgctagggaggcatttgaaaacacggattctaaactgaaatctcaagcctgttgtgtgagaattacagggtggcaggcagaagaatctgaatttttgtcaagtgatcattacacagacaacttggtatgggtctgaccgtctgcatctgagaaccgccagctgagtgactgcctacagataaataggtaagaaggagcagagcaacgattcaaacccagctggctcttttacctcagattgaggtcgtcctactagatccaacccatgctactaatgttggataacaaagaaagcaagagaagaaactcatatttgttgagggcctgttgtgctaaggtgctttttgcatgttttatttcatcctgtgctaatactgtgtggtgagtattttcagttcccattttacagatcaaggtactgaggctaagagaggttcagtcccatacttatggcctcatggttttattttatggaagggtagaataagattgaaatccaggtccttagtagggtgctttgcccctacaccaatgttatgcaagtatttgtctagatttttgcattctcgttcttactctaaatgaagacttgtgtaaaacttgacttcaaattttatccttattgatgaaattaataattatattagtagtagggaaagcaaaattgaacagaagaggaggcttccattttatgcttatagagacccaagctattggtctacgaagccataatcaaaacttagtcatctcccaccttgcttatcaaagtgtagtcccaggagagcagaatttgcatcacctgggagcctgatagaaatgtaagctattaagcgtcaccccagacctactgacccagaatctgcattctaacaaaatccctcggtgattcctatacacataaagtttgagaagcattgttctacccaacagctgttggaagacagataccttacagagaaataaataggctcttggtgttgtccctgccaatgcaaatatatgaagtgctggttgacagagcatgagccttggcttcagcccagcagatggtttgtagatagaactacgggtaccaatacataaaataaaatgtttgagttggtcgctttcgtggagttgttagtatatttatttaacttatgatgtcacggttaaagagctagaattgggtctgtttagcttagaacataaaaacatacagcaaatccttcttatgtatgggtgcttatccaatgtgttttgatcatgaagaggtttcttgttcaagttcagtggggagaatttataaactgaatttaagggtcttgtcaggccatagagtctatttcacttaaatgagtttcttactttcttatacattgtttattgtttctctgtcattcatatccctttcctgataactcttgggcagaatatttcaatattcaatgaacattgaaaagctaaaaataaaaattaaccattagtcttgatagttgctaggatctttggggttttttttttttgtacttatactagggttttgtttgttttttccttaagcaataattattgatttgtttttatgaggaatgttcccagagtgtggcttcagatgaatccgagcaacaaaaattaccttggcaagtgattttgtgtatacttatattttttggtctgagtaagaaaaatctacatttcacccaaagcacacaggatctatttctgcatcagccagataatgagacagtaattggtgtgtaagccgttcattctccaagttttctcacggggcataatttgtctcttatttgtcagggatgggttctacgaaacaacactcctattcatgatgggcagagcaaatgtacgaaaacattatcatagctgggattaatggtccactatggatttatgtcaagaatgttaatgatttgtttatgaataagtgggcctgtcgcatggtgaaacagtagcctgcagaactgctgaatggacagtttgcttgcagaggattcttgcaggaaataaatactcttgccaggccttttgcatctcttaagtagctactgtgaattgactctaagatttgaaatggtggcattgacctccccaaatcctgtgatccctgctgctgatcttgtaactctacattttgttgacataatatggagaaagaatatctttttagggttgaatataatttgggttttgtgtgtgtgtgtgtaaaaggtggtgagaaaataataatttaattaaatctcccgctgagcaaagtgcccacgacctccacccaccagattgtgtgttctttttgaagtgtattttaatttgtggaagatgtgaatttgcggcaggttttaattggtagataaaagtgttaattattgccaagtagagtctaggaaatgaaaaataaatcaagattacttagtgattcatacatgtacacatatacagatggaaagatacacaggtagatagctgtaaaaaatatagtatgtgtgtgtttgtgtgtgtatgtagtatgtgtgtgtatgtagtatgtatgtgtgattgtgtgtgtgtagcatgtgtgcatgtgtctgtgtaggttggctgtataaatgtttaggatgcaatttaatgatgtgtattctagctactttttaaacatttatgttttcaggaaggatgatgttgactttctcttgagaagagatttaaagttaaatgttattctatttatgtagaaaaacattaccttcttcttttcactttgggatagaattagctaagtcaagtttttcttgaatttcatccaaaaggtcttaataacgtaaataccaaagtcatttttttgtaaagttctagttctcattgtaatctgagaagtttcacaccataaatctgacctagagaatagtagcattaggctcctggataatcaggaaaaaatatatattcgtttaataacaatgacctctgcatgcattcactgaagaccacccgtaccacccataatgattcattcacttgatctttatagcagtcctcactgttctgaggttacaaagccacaggttgagccccgcatcaggaccatttgggtccagatctcatgatcattccgttgtacagtatacagcaggatcaaagcctgtgtgacctcacccgtcgtgttttctcctcttgtctaaattgccctcatgattctctaggtaggtggacaaactaatcaaatactattgaaacaaaatggtgggcacagatggccttgcagggatcagagaactccttgacaagatgtgaaaatcttgtatgaattttgtgctttttgggttttatctgattcttcaagaggtcagtgatccctgcaaagatcattttaccatgtttcaaactattaacttagtatatgtctaatcatactagagtggattaagatgtgttttttcaccattatcatcatcattttttgtatgtagtacacataattctgaagttgagaaactaatgttcctaagtactcatttaaaagtcactctcatttcttgcttgtcacgctctctataaactatagtttcctcccctgatcagcagctctagcaataaacaacagataaatagacttgacctcctcttgccattttaaagttcattagctgtagaagggactgagttcaggcatggtgtgtattgatcagggttcttccagcattaagagagaaacaagtttagtttgccaaattttcagctctattaaatttcattttaatactgtaataaacctcagtaaggtttattacattagacctatgggtctaataggtctaaataggtctaatggtctaaacattagaccattacaataaggtccagttatcattaagcaaacagttggatttggcatagagttgtcagcagagactcattaaaatgaaatctgaaggtaatatgttgaacatctaccatgcacaaggcattagtctccatgcttggagaagggaagatgtgcaaagccttggccaaatgcttaaggagctgggtatgtccacctgtgtgtagatggtgatcatgactcacctgtgtgcagactacttcatattctgctgctcacatttccgtcccttgaattttgatacaataaacatttcaaggtaagaacacttgactctaaatgctagattacagtagtatagcatattgttgctggtagagaaggtatatgaaattatatcatttatttttcttatacagtaagtcttcacttaacattgtcaatggattcttggaaactgtgactttaagtgaaatgatgtatagtaaaaccattttttttctcatcaatgttataaagaaaagttgttaaagaaaacaatgctgcttgaggacctgctgtatgtttcgcttaaagttgcagttttcaagagcctattgatgacattaggtgaagacttactatactttattaatatattttggcttaaggatttccttcccccatcccctttgtagatataactctaataatattgactgccaatgagagctgaacactgatcctattactttgtagccctaccgtctatatcaggaatgttttacttggagtctatcaacttcaaggacactggctctcaagtactggtattcactagaatcaccaggcgttttgtaaaaagtggagatgtctttctcctactgaatgatcttcttttgtaaccggtaccccaaaggactctgatactgaattggctggctatgtatatggacttcaaagagacatgagcagaaacccctgaaactgttttctaaatctgaattgtgcttattttctgaggagaggatccatggttttgtttagatttctaaagaggcctgaaatccaaaaagaatttatgaatcactgttcttaggatggaatgaaggacattaatggtaaccatatatctgttattctgagctctggagataaatggattaattcacagacagtgtgatgaaatcctattgtaattggaacactattaaagtaaaccatttccgcttacaagcttataaaaagtactgcttttgaaatgccattttatgtactttgtcagtattacttaaaagtgataataatagttgatgaccaggtgacaggaagatttagcttatattatatatatgcagaagtacattatttatgccttacctgaggctggtatggtggaatctgaaagtatcttgtgaacagtacatcaggcaactggagtactctttcagttagccatcccagtacaatgctcctggaagttttcagctcatgccaaaccccttacctgccattcattctataggaatggaatggtaagcaggcattgataactcaggtcagacatggtgcaagtataaataaaataatgatgttatcaaagtaattgacttgaattccaagaaaaattctttaagactcaatgagaggagtgaataaaaggcaaatcgatgcccgccctggattcatagcttcttcagttccctaaaacttcttgataatgaggacattttgcagagtagcgataagaacctcatattcttcagacgtgttttgttacacttccagacggtcaaattagtgggtagtttttctttagggattacgtgtgcttttctctttaagaaatgtttgacaattgattcccagaattgtgagagttttctctgtgagtgaagaaatactttaaaaaaatattttaaaaacacaatttaaatactagcttcacttctatttcttttcacataataggtggcaggaggaaagcctaggcctaaaaaatattgtgggagccataggaatgtggctttggctggttgagacatgaagaatttttatcttcacagccagaaagaaaaaaaatgccatggaagccaaagtgaatatggtttattataaggaaaatgcgaataaaaactttagtgagatactacccgacacctattgggaagcctactaataagaaccagaagtaagtattggtggtaagaatgtagaggaattggaaacctgatgcactgttggtgggaatgtaaaatgatgcaactgctgtggaaagcagcgtggcagttcctcaaaaaactaaaaatagggttaccatatgatccggcaatttcacatctggatatgtacacgaaagaatcgaaagctggatctcaaagaaatacttgtatacccgtgttcatagcagtattatttacaatagccaaagcatggaagcaacccaggtgtccattgacaggtgaaaggataagcaaaatgtggtaaatccatacagtggactacccttcagccttaaacaggaagggaattctgacacatgccacgacatggatgaaccttgagggcattatgctaagggaaataaagaagacagtcacaaaagaacaagtatgtgtccacttttctgaagttcttacagtggtcaaaagcctaaagatagaaagcggaatgatggtgttaggagttagggagagggagaaaacgggagtttttgtttaataagcatagcgtttcagtttgggaagatgaacagttctggagatggttggtggtaatagttacacaacaatttgaatgtacttaataccactgaactgtacactgaaaaatggtgaagatattaaattttaagttatttgtattttaccataataaaagaaatagaaaaagggaagatgatttagaggttttcacacagttttaaaaaatggctttcctagttttggtttgaacatggtggtattttcatagtgagaggcttcatggtatcgaagcatatcagaaagagagcaaaacccaattcagactctcctgttaatgcgttggtgtccattctgcattgtgttctccatacatacatacatgggcacccacatgccttcacacagcagggaacaggtgaggcattcccctttgtgacctgctcatttgacttaggatgtatcatttcatgtaattccatgataatatgcttagctttctatttgcctgtttaatgactgggaaggaattgaagagattattaaacgtttctgtgaaaatcatgtcattctagtggtggaggtaaattaaatcatgaaaaacaagagcaacatggttgaaagccctagatggaagaagatggaggtgctgggtagacaggtagcgtagtgggagctcagtggttgggaggaagagacattttccttttctccgacaagctgccagtgtagtgggggtggcagatacagttgctcacaattatgctaccgtgggatatatgatacatggagatttgaccagcatctcaacagctaactcaacaggcagaggagggttcctttatagtggctaaatggcatggggcccgtattaatgttacttcagccacatactgttttttcagtgcctttttggtcaaagcaaaacaaactattgggatgcactccccccaagcaattctctgtatacattcacttgattggctcctctgaagaatagagaggcaaagcgatgtgcctacctgagaacctgagaaggaattctagtattaatggcaaaaaccacaattacttttgcaccaaccaaataactcctcagatggccatggcctcccttcctgttggacctaggatgagtcgggggagtgcagcagcggagtcatcacttagttcaatagcctcacaaacgaaccaaattgccttcttcaagttctcttagtgccggaacctgtgcttctttcagaacaaggagaagaaggcatgagtttcaagttgacctactgaaagtcttgatgtgaaatacaattattagcaattgttaaaattattaaaagtatctgtatatgcacacacacatatatgtagaaactttttgttatttgatttcaaaattaaatttctttgctatatgtgtttcattatacagacaagctctgacttgcagaattctcaaatattcttgaaaactgttgggatagattgggttatatatatgtgtgtgtgtatatatatatgtgtgtgtgtgtgtgtatgtgtatatatatatatatatatatatataaattagatatttcccatttgtcttgaagacatatatattccatggaacattaagcagcttcctttaaatgcaatcatggagatagtttatagatttcataaatccaatgcttcctagtttaaggaaatatcctctaattcacctcagttttattttatgtgtgttcttattatttgaaaaaagatagttttgttcttttgctgtagccaccacaataaggcacatttattaaaagttggccacgggccagatactgctctaggtactagaacaatggtacccatccaactgtggtggagaatgagagagttcttgctctctgggtgatgagagagcccttcccatggtggaaggcatacaataaatataccaacaaaaattaaaatcaaataccacgtaatataatatagtataacaacataacatcagttggtactagtattgggtagaagataaaaagaaagcaacgtgatacttgctgggggcagtttcagcccaggagaaggaagacctttctgagaaggtgctcattgaaatatggatgatgataaggaggttgtctcaggcatatttggggtgggggttacattgcaggtagaaggatcagcactggcaagggtgtcagtttgggaacaagcttggccacagtatctagaacattgtgaggaaacagaacagaggaggaaaatgaggttagaaaagtcaggagttagaccttgttagccatggtacggagtttgggatattatcccatgagtgatgggaagctggtagtggatcttaaaacagagtcgacattatataatctgatctttcagaaagaacatctctgactgttgttttggaggacagattgtagtcaacaagagtggatgcaaggaggccagttatgaggctattgcacttggtttagagacgagattatggctatagcatgggagaaagtaagcagtggttgcatttgcaatatgttttgaatatagacccagtaggacttatcagtaggtaaggtgtaaactctcagagagaggaatcaagggcgtctcctagaattttagctgaaacaaatagctgaatggtggtaccatttactgagatgggaaggattccagggaagagatggatgacatggtttttggagaaagaatgtgtattccatatgggacatatcaatttcaagatcctgattcaggtatctagttaaagacatgaagaaggcaagtgtatacaggaacctggatcacagaggataggtctcatctaggcatatgtgtttgagagttattggaatatagctggaatttaaagccatagatcaggagagagtgtgggcagaggacagagctccttctgtaccagagaccttgaaatgtggactatcgtatcaactgcttctgagggtagatgttgagaacagataattgccttacagttggtgaatgtttgaaaggtatttatgttacatacataaattccaattaaattatgaagtctgtgcaaaaacctcacgtgttttgttttgtatctttctagtacaacgggaaagacaataaatttcgggaagatttttctatatagtttccagaaaaatatttgtttgaaaagctaagactgatttctcaaagtgccaatattttacagcctcctgttactttaagcctgaaagctatcagcggttttgtaattagttggatttgcatcaagaactcaaaaaagttttatttgagttgttcattttgctaccactactttaaaactttaggttttgagccggaatactaatgttaaattggttgagtttttcagagcattgtctttgatgaatgcatttgaatgaaatgcatttgaaatggttgtaacatagtcataaaaggaaaattatgatgacccaataaatatcaacattccattgcttgaagaatttaaaaacatatacagcctcggtaaggtattggtgtcgtcattcaccatgctgtgaatctcagaaataaaagcaagagggattatattgctttgacctcagttagggtttagtaagaaatttttactttatcctggtaccaatttgtaattgtttaccacccaatgtagaacactaaacatgcgttatttctataatataattatgctgcatttgaagcgtatgataaaaattttgtttttatctgcaccttaaaaaaagaaatatgtgattcataatatgcgattacataagataggtatagaataaacctgaattactatttttaagtggtgctatgtataatgtatcttctctttttgagtttattagagttagattaatatgatgataatgcccagtggtacttcactggatagaaggtgtgatttccagactatgctgtaacacaaaaaatactgtcaaattttttttcttctctttaggaattttattacatttttttcttgcaaaggttttatgtaccatcaagggttatgaactttgatttgggttatatcaattaagttgccactattacttatataattcaaatttgtgtgccttcatttctcagttatggaaagtggcttgttagtatctcatagtattatttgttatttcacctttgtatcctaatgtgttttttgttgactattttgatagtatgttatctggggcataaaagggcatgcttgttacagtttaattgaaaattttgccctttgtcagtatacagtgataaatatgtttgccttgtgttctacagttgatactgtcttacttttttgtctatatgcttgtccatttatttttagctcattggtatactagtgtatcaatgctacttacttactttaatgttctaatagtaagcctttaataaaagacagatctttgtctgccctaggaaatgcatgtaacatacgttctttctaatccttacaaaaacattcagaggtaaatattattagttccagtattatggataaaagaagtgagacccaaagcataaatatgatgtgcacaggatcaagtaattaataatgatggagctggggttttaagccaggtctgtctgaccacaaagtctgccctgcattccctgcaggcagtttcataagcgatatgacactgcattacatgtagcccagtctgagaagctttaacaagataatttgactgatttacatgcattgttgtaactgatgtacttagaaacatttttatcatcttattttgagctttgttgtttttatgatttcttatactgcatgttttaatgaattgtttttaattttgttttctccattgatttggaaagtatagataacttttagtcattaaagccatagattctttgattatctttgaaaaatatttttgaaaagggataacttttagtctttgaaggcatagattctttgattatctttgaaaaatatgtttgaaaaggctaacctatatttcttttatcaaggttaacaatgaaactgtatgttttttactgcctctgagtataaaatagaatataatgaatttctttttccttctccctcactattttacagtctttgaaaatgtaactgaagggttttataaccaggttattattactgagttatgatttttagattccatatagtgtctttcaagaaacagttttgacttttacttttagtgttgtatacatatattagtaactctttatattcacctcgatgtttaactggtttagtggtcagttctcctatatcacacttttacaattcttggattcttagtgttggtacttctctcagtttgcatcgtttaatacatttattagaaaagaatgaaatgtgggttctatatattctgagcatttgcagtctataaaaatgatgtgttggatggattctttgttgttttgattaagactctgtaatgctctgaaaatgtaaaaagacataatctcagggctgttcattacaacactgtattagcaaaagcctgggaatatcttacaacccataagaaggggactgatttagtaaaccatgaaacactttttgtctgtatgcttgtccatgtatatatgcttgtctatatgcttgtccatgttctaggtattgtgcagttatgaaaaaaataattatctctaggacatatcactaagctaaaaattaacaaagtagggaagattgtgtacagtatctatcactgagctaaaaattaacaaagtagggaacatcgtgcacagtatcctagtgtttaaggaaaaaatgacacaatatgaatggaaaaatatgaatatatgtatgtatatgtatgtgtaatatgtgtatatgtgtttatacatgtatgtatgcatgttatgtatgtatatgtatatacatgtgtgtttatatgtatgtgtgtatgtgcatgtgtgtgtgtgtatatatacttcatttatctatgtatatgaaggataaaccatatgtatatgaagaataaaaaatgaggtttcaatgggggaaggaagggacagggcagaagggtagaggggactggtatagaaactagaattttctaaatatagcaaaattttgtgaaaccatgtaaatgttttccataattaaaattaaagcaaaatacaatatataatctctaaaacctgaaatcaagatttaaacgatgcagataaatttgtattaatttaatgattcaacctcatggacaagaattatttcaagtaactgtaaaacattcactgactgtcattagtaagatataaactaaaaacaaagaaaaaatccgcaaagatatattaaactgcttcgtagtaatcatttgcttacagtaatttttttatagcaatgagattggcattgttattttgagcttttttcgggtgtgtgtatgggtatatatctatactatatacatgtacatttgcatatgtatatatttgtaatataggaatgttaattgttttattctaaaatatcctatcaggcagtattctatcctctattacttatttgctttatcctgtgtgtacacacactcactcacatacattaaccgatatgtattgcattctgttatatgtatttcatatacattatgaaatttttaaaaatagggattatgttcattttattaaggaacctagagttaatatgaagctcaggattaaaaggacattctgtaattctaaatttgatctggaaatatttttgtatttagtgtaatcttattgtattttcaatttacattctccttaatttaaaaattctgtttcttagaggtaatatcatcttatgtgctattgaatttgaaaatgatttttatttttttttaagttcttgtagtaatgatatgtgaaagcttgcctccacagtaagtctttagaatgacattgtctttctcttattctagaatatttttcaaaggctctgtgttggtttcttctctttttaaaagagaattgcctaaaattcataaggattgagatagtaataaatcttaggtcttctgttgcttcaatccaattagttaatggggttttttaactgtgcatttttttctcttctgactttgagattaactagccatctagaaattattttttgaaaactcagaaggttcaatatatccttggaataactatgggtcaattctaaacccagaacaacaaattaaatttaattccctcccagaattttcattaggctttctgaaccataacttggtggcaagggactggagattattcttgttatacatggggtaataaattctctttgacaatatcccccattctgcagcttcaatacctctttgcattattgcttgccctcttgggaagccattttgaaaataacatatggctttccccttcattttgtgaagccagtgtttaatttggctgggagcaaattttacttgacatcaattttacttgtttttctttccggataaattactttgaaaggtcttttttttttttcccaataaggctacgatataatttttattaagtacatactattaagtatatattatttattaattatgtgtcatttaagttcttcacacacacatactctctcacacactcacacacacgacataacaaatagtaacaataacaataaaaatacagccctcttctgtaatatcttagggacttgactcacaagaacaacaatattgtcctttgtctttacatgtggtctgtgtgtggtagactaacaatgcttgaaaatttgttgctacttcttccatttggagatggagtttaactccactcctcttgaatttgggttggctttagtgacacgactaacaggatgtggcagaagtgattttctgagactgatgttagctcagaacaagccttagagcagcatcagcttcttcccagacctttcggaacccagctctctggaagctctgagccaccatgaacaaagtctgactatcccaagaccactggaaaaggcatggacaaggggtctagccaagaatctcacttgaactcagtcttcaacccatccctgccaagagattcaactgtgaatgaagtcatcttaactggcctgtccaccagctgaatatcaccggttgatcctggtcaataccttgtgcagtgaaagaatcacccagctgagccctgcccatattcctgatccattaaatcacaagatagagtaaaataaggatgctgctttaagccactgaatgttggagtaatttattatacaataagagataaccaaaatagcatatctatactaatctctgaagtgccatttggatatgatgactgaaacagcacattaaagaagcagcatggaattaggagcttggacatttatgttccggtattgttcctaataacctgtgtggctgagagcaaattaccttgtttctctcaactttttttttggttataaaagagaattggcctagtaataataataagaataaacctcaatgcaataaaactaaacatttattgaacgccattgtgtcaggtgctgaagtaagacttttaatccattatctaatttaaacaccacatcatccttgtaaattataggtatcactatgattattaccaatttaaagatggaaaaacaggcttggagatagcaggaaccttctcctgtatgttccataagatacttttgttgttaaccttcagtctttgattattgggtgtctatgattcttcaaattattgcttgtgaattaggatttcctttttgtgatagctcaataataatttcttttttattgttccaaaataaattttatagttatgaagtaggacaaagtcagttacataaagagatcacaaaggtctacagtacaatttatccggatactcttgatatgttgggacagtagaagcaaccagaaatgtcaaaaggttcttcttttggtccccagtcaggttgtaaggaagtcatactagaaagtgtaggtgcaccttacaaatgggaacatactagtgacaacagttgacacatattttaaagaaacagatcttggcagagaggataaaaaaggtactcctaggacaactgtcaaaccgtgttgtgtattgaaagagctagtcttcctcttaattactggcaaaaagtaaattgccctacattttctgtatttttttggtttggctttcttttttataccccctattttcttctaataatttttctttccctttatacttatatagtgtgtgttcattatcacttaaaaaagaaggaaggaaggaaggaataaaataaattaggaaaaccactaatattaattgggtgcctttaatttgtgcttgctatttcaggtttaaatttttaagcatttaacatgtaaatattttagattgatttggttttcccaagccacctgggtagtaaaagtgaaattggatttgaatccattttctaaacctgtttgtgatacacaatattcctcactatctctcatgagcctgctctttagttgatgagatttattttactttaatttgactaaccaatttttaaaaaaatcttaatccaatttaagagtgctgattcacatattgcatagcattccctggtgctttgaacctgttaatttttgttgaagtattaagaatgtctaaatataatctcatgaatgaacttgtgagtggattgaaaaatacccctaattcttttagggcttagttgcagggtgtgtattagctgctgaactcaaatttattcatgacgaagatctctttgaggcactgatggatgtatcacttcatggtatctattgggaagcattttgtatatggaattgtgctctgtgccatgccaagggagccctgagagaggaccctggttatatgagcatttcattcctttctcttgagagagggtgttggcatccttagaagctccctctttccagagcactgggccacgtggctgacttgctggctgccttcatttgatacctgtgaacactttcctttagcccacttgttctccatcggtggcgatttgccctcctcccaaaagacacatgacattttctaaagacagctgggagattcagctgtcatctaatgggtaatggccaaggatgctgctacacacccaatacatccaggacggtccctcaacaaagaattatgtggcccaaatttcagtagtactgaggctgagaaacccaactctggtttcccaatcttttgttttcattgttgctcccctaaagatccttttagacattttttccctagtaacatactcctcaatgaaatgttaatgtgcttcattataatggtttatatactgttgttttatctgtggtttacacataagaaaaataatcggttattttagctatcaagaaccagtttttgcctctatgggggtgatgtggtccctgttgagagtgcatgtaccagtggatctccttgggaagtgagaggcttgtaaataacccagcccacaacaaattgttgaatgagacagaaaaaacaaacaaacaaaaaacaatagaaaaagaaaaaacccaagaagagccgatatacctaggaaattagtaatgatgcttggaagcaaaatgtctgcccaatatagtatcagcagtcaactatgagctgtagatagaccgataaaacagattctcagtctttctcctgcctctcaacaggcaggccccctgccctggactcttcttctgcagaaacaatctatagacagggacttaatgttcacatcctctctctctgtgcccgtctcctctgtagttgatcagtgggtgaccatctctgtttcccctagttccttccaggagtcttcaaggatgcctgttccatgtctggctcatgccaaatgccaggaattccattgggatagacagactgggtcctgcccctcctgcagcctggggtatagctcggggctggttcaactctatcatttgcataatacagttgccagtgttttgataccttatgccatctccacaatttttgtatagctgtatggtaactgaaatatttactctctctttttattaaattgacacatcttgttaggtaatacatttatttaaaagggaatatttatgccgttgccgtagaggggaaccaacgtcacttgccataaccagaaggaaacaataaaaatgaatacagtggaaaaaaagttcatgagctgttattgctttctgagggctctgagcctggagtcagtaatcactcagcttaaaaggaagataagtgtgtaagaaaggtggtgaaagtatactggcatcaaactgaggctttctcactgataccgatattagcaatttgaaagataattcaaacgggaataactttctcattatttaagggagatgaatactatataattctgtatctgtgggctagattaaatcatctcatgcaccccatgaggcactcccacattttgggaaacactggtaagctaagtccagttaactctctgccccgcccttgcctgcccctcgactgttctgcgttatggattattatcaacagtcaactatgagccatttgaggcttctttttttggttgttgatggagtttcactcttgtcgcccaggctagagtgcagtggtgcaatctcagctgactgcaacctccgcctcccaggttcaagccattctcctgcctctgcctcctgagtagctgggattacaggcgtctgctactatgcccagctatttattttgtgtttttagtagagatggggtttcaccatgttggccaggctggtcttgaactcctgtcttcgggtgatccacctgccttggcctcccaaagtgctgggattacaggcatgagccactgcagccagccaccatttgaggtttcttatttctctttgggctcctagtgccaagcaccatgcttgacacagccacagtgtttctctgccacttgcgtgatctaatggacctggggctgtgcattgacctcacattggcccaggtagtgtgtaaattgattctgcgtgacttagggttgggtgcagctccatgtgtgcatgcttggtgagcagaggattcagtggatttcagcctctacctgcccttgactgaaaggcactcttttgcaagaacaatctatacaaccacacccagctgctgtgtatgacggtaaatgagatgtggttaatagacacgaagagaactttcacttcacgagttcttctcatgatttaagggtaacctaagaagttcaatttttttcaggcgtgcctttgatgtatttattctctttgatctgaggagcacttaaggagccgttaccagtaattgtcattgagaaaaatttaatacagaagaaaaacagactttatatagatatttaaaaagatgcttactaaagaccaaggagatttaaggagcagctagttcacataatcatcttatgctgtagagtaaggatctaaaaatcaatatttctttaacagaactgtgctctgagtggtgttaccttccttctctctctctcttttttttttttttttgaggtggagtttcgctcttgttgcccaggctggagtgcagtggtacgatctcagctcactgcaacctccgcctcctgggttcaagtgattctcctgcttcagcctcccaagtagctgggattacaggcacccgccaccatgcctggctaattttttgtatttttagtagagacagggtttcactatgttggccaggctggtctcaaagtcctgacctcaggtgatccacccgcctcagcctcccaaagtgctgggattacaggcgtgagctaccactcctggcctaacagacacaatctcttctgtttcttttttggttctttttcttccttccaccagtcactctcttcccctttcttcccctttccttctctcttttctctttctctgccttttccttttttaatttttttttcaggggagaagcaaatgcatcccaaagtcttaaaaatcatgcaaatatttgtcatgacactgttagaccatagctgaccaccaagaaatgaatggaagccagttggacaaggtcaaagcaggataggtcagagtcaactcttttaatgcccctgttttaaagatgaagaaacctggagagaatgaatgtcttacctcagccacactgctttttttgttttgatgatgtgtatttgtaatgtataatttgtgtcatggatcagaattgatgagggtaactatgggtttaaaagtcaataggaataagtagggataagaatgtgaagggtaaacatattctcagtgacacagtggtaccagtctgtatgtaattcagcaaatatttttgagtcatttcagcggatgatgaggctaaagccagattagcatgggtttatgagagaggggcaaaagggatactggagaagagggtgaagcaactttaaaactgaggttttctatagaggggatgggagaaatgggaaaatagctgtggtggaggagagattaggaggtgtggattcgaaagaggatttttgttttgtttttagccaggggaaattatagcttgttttatgctcatggaaatgatcctggagagaggaaaacataaatgaaataagggagtgatatggtttggccgtgtccccatccaaatctcatcttgaattcccaggtattgtgggagggaccagtggaaggtaattaaatcatcgtggctggtctttcctatgctattctcgtggtagtgagtaagtctcacatgatctgatggttgttataaggggggggtttcctgcacaagctctctttgcctgccgccgttcatgtaagatgtgacttgcaccttcttgccttctgccatgattatgagacctccccagccatgtggaactgtaagtccaattaaacctctttcttttgtaaattgcccagtctcgggtatgtctttatcagcagtgtgaaaatggactaatacagtaaattggtaccaggagtggggtgctgctgaaaagatacccaaaaatgaggaagtgactttggaactgggtaacaggcagaggttggaacagtttgaagggctcagaagaagacaggaaaatgtgggaaagtttggaacttcctagaggtttgctgaatggctttgacaaaaatgcggatagtgatacgaacaataaggtccaggctgagatggtctcagatggagatgaggaacttgttgggaactggagcaaaggtgacgcttgctatgttttagtaaagagactagcagcattttgcccctgccctagagatttgtggaactttgaacttgagagagatgatttagggtatctggcagaagaatttctaagcagcaaagcattcaagagttgacttgggtgctgttaaaggcattcagctttaaaagggaaacagagcataaaagtttggaaaatttgcagcctgacaatgcaatagaaaaggaagtcccattttctgaggagaaatccaagctggctgcagaaatttgcataagtaatgaggagccaaaagttagtccccaagacaatggggaaaatgtctccagggcatgtcagaggtcttcatctcagccccttccatcacaggcccagaggtctaggaggaaaacatgttgttgtggcttgggcccagggtcactgtgctgtatgcagcctagggacttggtgccctgtgtcctagccactccagctgtgactgaaaggggccaacatagagcttgggctgtggcttcggagggtgaaagcctcaagctttagcagcttccactctgtgttgagcctgctagtacaccaaagtttgctataggagcagggctcttatggagaacctctgctagggcagtgcagagaagaaatgtgtggtcaaaacccccacacaaagtccctactggggtgtcacctaatggagctctgagaagagggccaccatcctccagactccagaatggtagatccaccgacagcttgtatcgtgcacctggaaaagcagcagacactcaatgccagcccactaaagcaggtaggagggaggctgtgccctgcaaagccacaggggtggagctgcccaagaccataggaactcaccttttgcatcagcatgacctggatgtgagacatggagtcaaaggaggtcattttggagctttaagatttgactaccctgctggatttcagacttgcatggggcatgtagtccctttgttttggccaatgtctcccatttggaatggctgtatgtatcaaatgcctgtaccctattgtgtctaggaagtaactaacttgcttttgattttacaggctcgtaggcagaagggacctgacttgtcttggatgagactttggactatggacttttgagttagtgctgaaatcagttaagactttggaggactgttgggaagacatgattggttttgaaatgtgaggacatgagatttgggagggaccaggggtagaatgatatgatttggctatgtccccacccaaaatctcatcttcaattcccacgtgttgtgggagggacccagtgggaggtaattgaatcatgggggcagtctttcctgtgctattcttgtgatagtgagtaagtctcatgagatatgatggttattatgagggggagttttcctgcacaagctctctttgcaggatgcaaagctctctttacatgaatgcctgctgccattcatgtaagatgtgacttactcctctttaccttcccccatgattgtgaggcctccccagccatgtataactgtaagcccaattaaaactctttttttctgtagattgtccagtcttgggtatgtctttatcagcagcatgaaaacagactaatacagggggaaagacttgctggagcagcatccctaagtagacaggaggggatgggatcagtgtgcacatggaccaattggccatccataggagtatagcgagggcatctagagaaacatgaggcaagatggagtcttggcggacagatgctgagggatgtgagcttagaaaagctctcttctgtgtgcataagtgttttcagagataggatgtgtgttagtttcctaggcctgctatagcaaagtatcacaaactgggaggctgtattagggttctctgggaaaacagaaccaatagaatatatatatatgggatatatataggatatatataggatatatatgtaggatatatatatatggaggatatatatatgtagcatatatataggatatatagtatacatatagtatatatagtgtatatatatgggatatatatagtatatatatagtatatatatgggattttatatatataggatatatatatgggatacatatgtaggatatatatgggatacatatataggatacatatatgggatacaatatgggatatatacgggatatatatacgggatatatatatacgggatatatatatacgggatatatatatacgggatatatatatatatacgggatatatatatacgggatatatatatatacgggatatatatatacgggatatatatatatacgggatatatatatacgggatatatatatatacgggatatatatatacgggatatatatatatacgggatatatatatacgggatatatatatatacgggatatatatatacgggatatatatatatacgggatatatatatacgggatatatatatatacgggatatatatatacgggatatatatatatatacgggatatatatatacgggatatatatatatacggtatatatatatacgggatatatatatacgggctatatatatacgggctatatatatatacgggctatatatatacgggatagatatatacgggatagatatatacgggatagatatatatgggatatatatgtgtgatatatatatgggatatatatatgggatatatatacatgggatatatatacatgggatatatatatgggatatatatatgggatatatacatatgggatatatacatatgggatatatatacatgggatatatatatgggatatatatatgggatatacatatgggatatatacatatgggatatatacatatgggatatatacatatgggatatacatatgggatatacatatgggatatacatatgggatatacatatgggatatatatatgggatatacatatgggatatatatatgggatatatatatgggatatatatatgggatatatacatacatatgggatatatatatgggatatatacatacatatgggatatatatatgggatatatataggggatatatataggggatatatataggggatatatataggggatatatatatatatatatatatatatatatatagaaagagagagagtgaggagagagagaaggagagagatttattataaggaattggctttgcagtgatggaggctgtgatattagagatctacagttggcaagctggagacacaggatagccagtgatgtggttccagtctgggtccaaaaccctgggaagcagaaatgatggtaggagttctagtccaaaagccagcggtctcaaaacccaagaagagctgatggttcagtgtgagtccaaaatcagcaaaagactgatgtacccactccaagagattaggaaggaggaatttcctcttacttgatggagagtcagcccattggttttatttaggccttcaactaattggatgaatcccacctacattaggagaagcaatctgctttactcagtctaccaattcaaatgtgagtctcacccaacacaccctcatagacacacttagaataatgtttgaccaaatacctgggccccatggcccaattaaggtgacacattaagttaactatcatgagggcttaaaacaacagaaattgattctttcacagtttgggaggctggaagtcccatatccaggtgtcagcagggttggttcctaacgaagaatctgttccatacctctccctggcttcagggggttgctgaaaacttggcttgcataatagacacttgcctccagcctctgcgtccatcttcacatggtgtactcccatgcgtctctgtgttcaaatttctctcttctcataaagacagaagtcattgggttagggcccatccttgcccagtataacttcaccttaacttgattacatgtgcaaagaccctatttccaaataaggtcgcatccatgagttccatggttagaacatcaaacacattggaaaacatagttcaacctatagcgggaagcaaagccctcagctgagaatgagaatggggaagaggagaaggtattaaacattcatgtaaatgagtgcattaagggactacagtgagaatgctgagcagcctgaactgcccacttgggggttaaggcatgaagtgtacgttaacagccagcttggtcatgtggatttccccagacctgggcatagatccacaacttgatcagaaagtgagttttacatggttgattttcaagagagctgatgaagtagtcaatcaaagtgtagtgtatgaaagggaactgtcatgatgattgaccttggaaattaagctgggtaagaaagaccaagggacgtgagagggcgagtcacagggaacagatggcagatgaatgggctgaggtccctgtctggttgaagatggtgggaatccgtggccttcagctgaaaaactaaaagctcatggtcagggagttagatgcttaaaatggagctgtggacaagtgacctctaagtacctaagattttaagtaaatttcctaaaatcactcaactgttgttctagggaggcttttttttaatactttaaaaaatatgttttattttgtaagagcagttttaggttctcagcaaaattgaggtggaaggcatagaaagttccatatactctctacctctttccttcaaaacacacagcctcccccttgatcaatgtctctcaccagaggaccagaggggcacatttgttatgtttcatgaacctgcactgatacatcattaacacccagagtccatagtttacattagggttcactcttgctgttgtacttctatgagtttgggcacatttgttttgataggtatccaccattattgtatcacactcagtagttacattgccctaaaaatcctttgtgttcttcctattcattcctccctcccttcaaacccctggcaaccactaatctttatactgtctccatagttttgctttttccagaatgtcttataattggaatcatacagtatgtggccttctcagattggcttcactcagtaatatacatttcacttagtaatatacatttaagtttctctttattacttttaactgtgccattcaatcttattgctggaggcaattcagagggttattaattttcattacaaaaaagtaatctgttcatactggtgatgctttcttaagtcttcatcacttaagtgagagacatctctgataatgataatgtctacaaagagaaataaagcagcatgtcatttctagcttttctattgcagttaaatggttcagaacttctaaatgtaaaattaagatgctaaggatattgtagttataaatttggatcttttgattatcagtagaaaagccttagaggaatatttggagaaaaggctgatcagtgtaatttcctgacttcactgtcatcttgtattatgtataaggtggtagtgaatctgatttcaaaagatatttgctgatggatagctttgatcttgccgttgattctcgtaagattctcgttgacatctcatagcctgcagaatatagtatagttttttatgacctgagctatatcttttttttttttccagcatcaacttctgctgttcacctttttggattgtatatttcaaccaaagtagactcttgctggttctcaaatacaacgtctgctttctgcccctgggctctttctcccttcggggcctcatctgttagcatcctgttatctcacctgaccttcaaggccgtgcttagaggattcctcactaataaggcttccctttagtcctgagattctccaacattatcccatatcagaattagctggagggtgaaggtgtgggttgcccctccacacctgtgggcgtttctcgttaggtggaacgagagacttggaaaagaaagagacacagagacaaagtgtagagaaagaaaaatgagccgcggggagagttctcttttctttgtgaagggcagggtgccctggaatgggttcgccccgagagaggggcccgtgccttggaaagcgtcgctgttctggcggcgtccagtgaaacagcagttgaacacgggtcagtcggtcctgagagatgggcgagcgccgttccgaagggacaggcaatggcctcccttgccctcagcggatcgaaagggagtcgggttcagatccccgaatccggagtggcggagatgggcgtagtggagttgatggcatacgaagacgccaatcctgagtgtcaatcagccgttaagtcattaaaaggaaaggttcccgcaggctcagatgtaatctcagagtatttaaaagcctgtgatggaattggaggggcaacccaccccttcagagggcttgctaggtggcaggagacctggcctcatccccagagattctgatccagcaggtctgtggtggatcatggaaacctccatttccagtaagttctcagatgatgctgatgctgtgaatccagactttgagaactaccatgctgaaggtttgaaatctttttcttagttacattgacattttgagactttttttttccttcctaaagcttcattctgtcactggaagcataatgttagcacatacttattaagcgataattatttatcaaataatgtcttctatgcgcatacagatatgcactttagatggattactaattcccaactaactgcaatatttataacacttaaaattatgtaggacataatttaatctttgatgagtcgaccaatatctctgttctgtgcattgcctaaggtgtaccttataaacatcaatcacttctggtactctagaaaaaattaggtcacttgaactttctgcaaagactcatcaagcagaggtttaaaagatgaaggagacttcagatttgggacctgtatacgaagtgcatgtggttgtaattattggcatttattcgaactacaggagatttagccagtccctttgacttggctcttgtgttggtgcagatttggtcttgtgctgggtgggggatatgtccaatgagggactcagttgaggacaaaagggacaaggtgagtctgggcagatgggcctgtttctgagcagaggtccgtgtggccaaggagagtccagcctcttttttgcttcgtgctgctcagttcagggctaaatccaggacaaacaaatgacctacacgcagctgcctttgcttaaatcagctcagcagactgtgttctcaaacagctagataaaatctggcatttactttgtatctggcgacctttgctttgaggagagctgcttttttttgttgttgttgttgggaatcttgcatgattgggttttattataatcttgcattaaagggcatatgcaatttccaataggttagtaatgaaaatggttcagtcttactaaatggacgctatgagctctttttaaatggtatgaaaatttgagggcatcttttacttaaaacttacttttgagtagttttttttcctccaaattctctctttctttttggtgttcctgttcatcactccattttaagagtgggctttagtgttttgaatgggaagcattttcctaatgtggtataagattaggagccagaggaacccagacatccactaacatctttagaagggaatatacatggaagggctctgttttctgtaggctgggtgggctgggggctgatgggagccatggaggtccctagcctgcaggctctgtctgcgaggactggccattctttggcctctgcttgtgggaaacccaggactttcacagcttctctgtatgaatggggaggggcacagagcctcagtatgaggagacacagaattgagatcatgaggggtaagatttgttgatggtcttgggaccaagaggggagtgaaatttgcaccttctctttttaaacatttgcaaaccagaggggtgagtagtgaaagagttagtggttaaagggatcacatgcaatttctttggactgagttttcacatctgacctttccagagaggatctggctttgggttggggcctcaccctggggtcagctctgctcttcacatggtctccatgtgtcctccgtccttccttctcttgacttgtgcccggtgcatagggacggtcccacttccttcttcacatctttttctgattcctccagaccacaagagacactttccgcctctgaaatgtcagaggatgtgtagtctcgatcacatagtctagctctgtacagaatttgacacttaatggcaaaggttaatttcaatatgggtcatttaaaatgcctttataaataataaaatatatttaattggatataattagtaaacattcagaagaaatggactttttttttattgtggcttattatagaaaatgaccataaaatttatggcacagtggccaggaggattagagtcactgagaaagactacaatcaagattaatgttgggacaataagataatcaccaacaaaagaattattacctgtattttctttttcttaaaaaaaactaattgaagaaaataagctaaaatttctatatacacctttttgattaagatgccttttgacatgagcttacggggaggtttttgttagacaactgctaacgcctgccaggagggacacacccaggagatgcctgtcctgagcagctcacagcactggccttccccactgggaagttttggttctgttgtggtccctctcctgaggatagagagctctgatggggaaattgcaatttaaattcatgttcgcctcaagtatgaaagcttctatttcttttcctcagcttctgataaaataaaaatatagcaataaggggatttgattaaaataactggctgactatttttattaagtagatgtacagtttaagaaagagaagggagtaaaaactgcagccccagtctctgacttgggcctgtaagctgctgctggggctgacagacactctggaaagaggggaaggtttgtcggtggggagaccctggaggacaagtggcccagtttggggcattttgattttgagctgcacacctgtgggctcagttattgagcctctttgttcctcagttttgaccactgtaaatgggtttaaccgtagttcctacctcagagcattgtcgtgagcatttcctgagtcattatacctgacatagctctggaggcgcagctcaatagatgctagccaagagaatgactgacaatgatgatgatgatgatgatgatgatgaaagatgccaggggttcaactggatagttgttcccctagtctgtctgatcaacattttttcatatgaatcctttccttatcagaagtctaaaacaacaatctgtagaattcacccatgaataaataagtcactcatgaaaataagtcacttggtgagatgagagtgatgaaaggcagacatgttgaaatcagtgcaaataaggagggggagaaaagagatgtgatgaagaattgagagaatgagaaaagcaaaagacaacgaaaaaagaaaataacaataacaattaattatgtaggaataattcacgtaacaattatggctaactttgaagctcttgcctgatgttgggacctgggctacctgttctacttattttacccagttaatccttatgtagccctgtgaagtgcatgtattatatataatcgtccccatctacagatgaacaaactggggcttgggaggcgatatggttggctgtgtccctactcaaatctcatcttgaattgtaactcctaccattcccacgtgttgtgagaggggcttggtaggaggtaattgaatcatgggggtgggtctttaccatgctattcttgtggtagttaataagtctcatgagatctgatggctttctaaaggggaatttcccttcacaagttctcttctcttgtctgctgccatgtgagatgtacctttcacattctgccatgattgtgaggcctccacagccacatggacctgtgagttcattaaacctctttcttctgtaaattgcccagtcttgggtatgtctatcagcatgtggaaatagactaatacaggaagttaagttcacttcccaggtcatgcatctagtaagaggtggaaccaggattcaaattcaggcaacccttgctgttgtggaagaaatagagcttcttaaattctttcttcacctactgctggattctttctggcccacagtagattttttggcttccctttgttaactacatggtgaaggagaaagcatatgatgatgtctgtcgtacaaatgaaatatttgggagcatagggcttatacaatgccgtcttctttttcatgataaggttgaaaaacaatattaatggcaacagacaacatagtagatgtagacatccatcaagaattgttgaaatcaggcatgactaatctgcagactgtatgttataggaaaagatcttgtatttttaagtatcatcagcattgactagggttttcaaaatttgtaagaatgtaaggttttgaacttggaggcctggttccctaatagaaacaatgtacagcacaggctatatggggaatgcgtgctgaatccagggattgaaaatcatatgccccctgggcaaagtcagctgggcatgtgactatgagctgaggcaagcaggggagctctgagccaaaaggaaccaattaatggaggcttgcatgtggacttagggtttgtttaccgagaccattcacgggtgggaagtcaagtttccatatccttcttgtttataattcaatttgctaatctttttttgttttgttttgtttttttttttttaatttttgaaggttgtaggaactttggactaaactgtagaaatctaaatttcatgagcgtgttgaatgcagctaaggaaatataaagttgttctacatttacatgctaaatatgcacctgtttcaaatttgtagctttgatagatgttactttttggaataagtgcagggagcctgtgttgtacttgaggcagattatgggaggcagcagccgtggggatggtgaagtccatcacagatcatttggactgtaaaaaaaccttttctagtaactgcgaatcttagtgttgcgtagtctatgtttaggttgatatttaaatgtggcgaatggatgcaatgataagaaagggtcttctttgttttacagcaaaagagagtttgtttaaaaccagtggtcctcaaaaagggattagcatggcatgggctgggtgtgtaggagaatcacttattttcttctctcccccatccctctttgtattgtcttccaggatagggtggggcagtttgcctgccacttgcatttgaaaatgttttcacttcattcagttctggtctgaacaattcttttagagcagcctgtgtattttatttattatgataaagtatgtattcagtgtcttcctgattcttggaaatacaaaaatgttgttcagggagacttgcagtactttttgtttacaagctaattgactcataaacaacagcagccttgcttaaaatttaaaaaattgtatttgacaagcaaagtatgaccttgtgactttaattaatgaatcagtcacttaagaatttcttgtttactcagtgtttgctcgggtttcttggtatttgaacatagtcagaaacagggaacagagcttgattcagactgtggtatgagaatctgtagtggacttgccgtgtgtgtgatttagtagctttgtgttgtgtctgtgtcatgttctgattatttattgctttattacaaatcactcccagaattagttgctcaaaaaaacaagaactttttttctgtttgtaaatctacaatttggacagggctatgtgggccagcaggaacggctcaactggcactaaaggatccacttcaagatggcttattcccatggctggcaagctggcaactgggctgccctgttttctctccatatacacctctccttggggatgtttgagcttcctcacagcatggctggatgccaaggcttagtgttcagcaagtggaagctgccagactcttaagggttgaactgaaagggacatagacatctcctcttgaggtaggagtatcaaagaagttgcaatcattattaatctacaagaggccaaattggacggtttacctttgcctctatgagttgttcactttcataccttttagcatttatcatagtgttttatttaaacctgtactctctttcttttttttttttttttcttcatgcattttcagtgggaggaagcttggttctggggttggggaggggcaaaaaaaatctctgtaccatacagcataaataggtacacagtatatctgtggtactgacattttatgggttgggggaggtaatggggacagtctaaaaaggcccattggggggtgataatgtaaaaaatacttgggaaacattgctttacttccaagcccagatctgtagtcctctcttccataatgcctatcccagcccaatcccagcagtcagaattaattgttcactttacatttacaaccatttcatgtaattctgcattgtatttatgttggttgtataatgcttctttctctttctacattacctgaccgtgagctccgtaggtacctctatcatctacccgtggaatgtccataaactacttattgaattgaattgagatggactaagggaaagtaaagttttgtctttatccctcaggcctaccaaattgcacacacagcaagtccactacagattcttacaccacagtctgaatcaagctctgttccctgtttctggctatgtttaaataccaagaaacctgagcaaacactgagtaaacaagaaattcttaagtttgaggtctcctgagataaggaattatgtgcaagtagccttttgtgcatgcagaaacactgatggaggtcagggaagtggagcagggaaggggaagaggccagtgaaggtgctctctcctagttagctctcaggagtgaggtaagtggagcttagtcctgtgtggaaattctcagaaatggaaacaaccacccctccccatcccaactcagagttaagccacttgcagggccagggagctgaggtgtttatactttaactctgctactcattgattgagaactggggcttccagggggtgttaattccactgcacttttctcccttggctttggaagaagcttcagggcacaccgaagtggggaggcctgagggataagggaagagcactgatactaccagctctaggcttccttagcacacggtctaagaaatgtgatgactggccttttattttgaaacaggaaactcttattttctcaatgtcagtgtccctggttcaagttcagctccatgaaggcaggaaacatgcctgtcttattcaacactgcatactcagtagagcgcatgactcagtattaataagaagattaatgaatagatggctgaataacccagcagtaggatttaagaggtaggttctttattgtgtttcaattcaaaatagatcagagcaggtaagacacaagctggtaatggaacttgacagatgtcaagtgctgtttgccttcatgactcttagaaaacaaacagaccaaacacaaagtagaattgtgcctgggagtagcccgaactgcttatcgaaaccattggcattttggtgaccatgcatccttgagtcaattcaggtccactgaatttggacagaccccatgctaggtcctacccatgtaggttgatatctagtcctgggttgtttggaattatgttgggtttaggtggaatgaaaacaaataatgattggcagtggctggtgaaatatctatgctgaggtggactcatggagagctcacatggagagctcctttcctttctgttttgggctgaatagtgtcttctgagccccttcaaaaagtgcattgaggccagtggttcacgcctgtaatctcagcactttgggaggctgagttgggttgatcacttgacatcaggagttcggcaccagcctggccaacatggtgaaatcccatctctactaaaaatacaaaaaatcagccgggcatggtggcacgcacttgtaatccctgctgctcaggaggttgaggcaggagaattgctcgaacccaggaggtggaggttacagtgagctgagattacgccattgcactcctgtctgggcaacaagagtgaaactcttgtctcaaaacaaacaaaaacaaaaacaaacaaaatattatgttgaagtcccaatccccagagcctcacaatatgatcttatttggatataaggcctttacagaggtaattaagagattacaatgagatcattagggtgggccctaatcaatatgactgctgtccttagaaaaaaggaaattaagacacagagatagacgtgcactgaggaaagagggtgtgaagaaatgcaggcctaagacagcaagtgattggggcaatgcagctacaagcccaggaatgccaaaggttgccagcagcaccagaagccagaagagacaaagaagcagcctctcctggagccgtcaaaaagagcatggcactgttggaaccttgatttcagacttctagcctctagaactgttagacaataactctgttgttttaaaccacctggtttttggtactttcttatatatgcttcattgatcaatatttcaaacttgcctgtgcattccctccggtcaggaatgacattccaccctgaaactatttggaggagggtagagaggtccttcttcagatgtttggaccttttagctgttactcaaagaaagtcactttcctcattggaatgctttgacttctttgctaggatctggcgggaaggagccctttctgctgttgtaatttgctgagacgagcctaggccataactcctgtgcacagctccctatgatactgcaggcacagagccctttctgtccaaggaaagttgtatgatttcagtggaaccagtgtggccactgttaatcttcatggctgaagattgtcaacatcctgcaaaagagcatggatatttgactctggatttagaccagagctcattgcaagatggtgtccaggttgaagctatggagttgatggtaaccagtagtggtatatagtcaagcaacagaagggagtgaggcaagatgtgaacagtatggcttaggcatgtgtttagtttgaagacattgtttttaaattccaatgatatttttgtcactcacctattcattaatttattaatcaaatatacatttaggagctactatgtgccagacatttcgtaggtagtgaggatacaaagaagaaacatcatctaaacaatgtattcaggtgttacaaatgctatgaaagtatgaattattgcacaaggtacagttcaggcataaacagagagaggggttagttctaggttgggagtttcagaaaagcctttctagatatgatgataatgcccacagaatattagaattgctgtctccctagatgttggagattaattttactctttttgtttaaccttcctaaagataacgtgtagaacagataaattctgtcctccatagatggctttgcgacataatgctgtccactgagcttttattgaagtgaactctggcttgccaaagctctggcatgtcaccttcctgaccacttgaagccctggaataaaattatttttactttcttcccaaactgccaagatgatgttcaatcctgcatcaaccaaaacatattcctgtaaggaattatgtctagcaaaagtgaaatgaaagcaaaaccaaatgtgcatggacataaatatgtgtgtgtttataacatgtacgtgctatgttccgatgagcggggtattcactctgatactgtcaagctgagcacttccaattgcaaatcaaggtgcccttgggctatacttggggactgaatgaagtcccttgggacaaaatgagaaacagtccctggattcttaaattcataacatttggtctggtttctaaatcttacattgttttgtctgacttctttcattcttttgaaagtatgtttactctgttttgtttttattctctgctctgtgtcctcatttattacttcggaggaagataagcactcagggctgtttctccctctgcacttggtttgggcaggttttcagaggttgctttgtgtttcttgcagcactcccatgcgtgcgtgcatcaaagactgtcatgaagaggcgtctacttgatctgtgcctcatcttccatctaattacaaatcacttacattaaactttccataaaatgaaaacacattttttttaaattggtagaaaataaaaattatcaagaagagagcaaaagagaaaagagaaaaaaattatattcaattccacaacctgataatagctgctgttaacacttttgtatatatgtttttacacatttttaaatggttgtctatatttaaatggcagaaaataggagggaaaagaataaaaatttttgtaaatgcgtgcatgtgccagttactcttctatgtacttaatgtacattgtggggggaaatgttgcaagatgttagagaatctgggctctgacgttcaaatgcctcaaaatgaatctgccctgctatttttagagtattattggaaggtaaataacaacatccttgtaaagtaccagacagttgatgagaaagatatctttcacactcatgttgtctctctctgtctctcaaacacacacacatacacacacatatttatattaatttttcatgaaaggtattattggccttgtattattggcaaccaaagctcaggaagtacatgcgacttggccaaagtcaaatgtttggattttctgattataaaggtttccgtttcatagttctaagcgatgatgcagcagctaccttgtcagctcttgacaggggttcggaagtgatctggtatggcatgctgtcttcagaactgagccagtcaccagatgtctggggttgtgagtctagttttctttgaagcgtgtggctctggatgaccttggactcgttgcttcacttctctgggctttagtttcttcatctgtgaaataagggagtttgtctaagtcatctggaacattgcttctattctgaatattctgcaattctgggtagtttttcctacagagagttgcagggttcatgtttccacatttatttgtcagggaggatagggttaatatatctgtaagaggagatgtctgagaaggcagataggaagctgaccacaaccagatagtcagtattcatgaaaacgtaattatctgagttggaaagagacagcatttgagagaaaggaccttaggacctttggaaatgataagtaatgctaatgcctatttcagaacattttatttgtgtctgccaaacatatagcattcctcaatgtattaatttttaactgattaaaaatatgaattttactactagtttctgcctaggatgtaggaagctagagaaagcattgctttcattttaccaataagaaaaatccataccttctgagcctgtttaaaaacttaaaaaagaaaaatgtagataatttatacaatcataacttctcttgaacccatcaaatcatgtactatgatctgggatcatatagtacatccaactagactgatatatagaaaacaggggctcccaaaagaggctacaaatgaattctgactcactcatggcaaatcacaggaagaccatggactgcaatacaaaggggtaagaaaaatccagctaaaattattacatttttaaaagtcaattgtgggctagcatgagagtgtagaaccactgggagctggatgcccaaggagagtttatactaactcacaggctagtatcaagcaattgcagtcagcctttggagacaaggcaagagtgaggagagggaccttctcctagcctcaggagtacaaagaaagctgagagtagcataggaatattgaggcaataatggatgattacttttaagcaaaccagactccaccttaaggacaagctaatgctagagaaatggaagcctgtggtagagcaataaaacccaaactcaacccagttctagactagattgacttgaaaccccacaataattaacttgggcagaagaatgcaatgtaaaaatgctatttaccttagactatattggacatgatgctcggcattcaaccaaaatatatgagacgcacacacacagaaacaaggaaaaaaaattattgtgaagagaaaaagctgttgatagaaccagactctgagtagactcagatatggaatttaaaataatgatgattaatatttaatatatcaaacactattggaaaaggtggaaagcatgcatgaacatatagggaatttcagcaaagagataaaaaccatgtaagaaacagtcagatgtaactgctggggaaaacagtaacaatagcagaaacaatgacaacaaagtaaaagggatgaagaaggcctttaatgagcttattagtagattcagcacagccagaggaaaaataagtaaacttgaatataggtcaagagaaattacccaaactgaaatccaaaaagaaaaaagagtgtataaagttagaacagaccatacaagatttgtgggatactataaaatggtctaaaatatatgtaattgaaaagccagaaggagaagagagaatgggatggaagaactattgaagacataaaggctgaaaattttccaaaaataatggaagatatcaaaccacagatctatggattcaagataacactaaacatgacaaatactgaaacaagctatataactggcttcattatatccaaacagttgaaaactaaaaataaatagaaaatcttaaaagcagtcacaaacaaaagacatattacaaggaacaaaattaagaattataacagacttcttgtcggaaactagaatataacttagtctacactggaatagtagctgcatgatgctaaaatatgaacacaagttaaatctaaagttagttctaaaaagtattatttgaaaatgtacaagtgatgtttaacaacaattaaaataaaaattcaaaaattcaaagactactttccatttttaaaacttttcattttaaaataatgttagatttcaatagtgacaaaatagtataattttcaagcgtccccaaatgattaaattttgtataatcatagtagaataaaaaccaggaaagtaatattggtaaaatactattttgtaattttaggacctgattcatattttatcagttgttccaccaatgcttttttatgaggtatatgtcaatttaagatcatatattgtatttagtagtcatatctctttagtattctttaatctggtcagttctactgccattctctgccttttataactgtaacgtttttgaagagttctggcctgttattcttgacagtgtctctcagtttgggtttgtctgtattttctaatgatcacattcaggttatgcattttttggcaggactactacagaagtggcgttgtaaccttctcagtatattatatttagagacaagttatgtcaatatttctcattgttagagatggttattttggtcacttagtcaaggtaatgtctgccaggttttgccaaagtaaagttctctttgtaaaataattatcttctggaaagattctttgagacaatataaatatcttcattctcatcatatttagcccactaattttagccttaaacaatgattcatgcctgaaacattgctatagtgtttgcaatatggtaactttagattttgataatttcttctatatttataaaagtataactttactgtaaggatgagtttcttctttcctcccttctttcgtttcttcttttcttctttccctttctttccttccttccttttctctcccttcctttcctttcctttccttccccttccacttccccttccccttccccttccccttcctttcttttcttttcagtactgttcattgatattttttttagtctagggttataatccattacaaccattatttattgttactgaaattgtctaatgttggccaagttgagagctatttcaggttattcccagcgttcatccgacaagtcctcatcattttatgagcactatcttcatttctagctcaacaagatgccctgggatcatcttttgcttttcttgccccagtcctagaattagccatttatccaaggagaaggacattgactattaatttcatagggagtaatatcaatgcaacagttcagtttcaaagtcagcatggagattaaaatcatgtagagtcaaaattttacttgggaatctcttaggaaggcaccatgttagaggtcagaatttatttcttagtctgttccactcagcaaattttccctctagcattgagcaatcagatgaagccatttgaatgaattaaagggccatattacttgaaactattttttctctgaaaaataattttaatgaggtatactcgacatataataaaccatgcatatgtaaagtgcacaagttggtaggtttggatatttgtaaacctgcatgagaccatcgccacaaagctttcttcatgtacctcactctcctctcttcgttcctcactatccccaggcaacaactgatctcctctcagtcactatccattgatctatttcctacaatgctatataaatggaatcatacagtatgttctctttttttgtttgtgttctcaggataattgttttataatttatgttgtagtgtgcatctgtagtttattccttttcactttgttgaggagcattccattgtgtggatataccacagtttgtccattcgcttgatgagaaacatttaggttgtttctaattttctgctcttaaaaatatagctactgtgagcatttgtgtacaagtcttttataaggacatctgctgtcattgctaatttttcattgctagacaatagaaaacaatagaattttgtatattgattttgtgtccttcaactttgctaaactcatccattctagtagtttgcttttttttaggttatctaaaagaattgttggattgtctacaaagataatcaaattttctatgaataaagacaattttacttcttcctttccaatatggagtcttattatttctttttattgccttattgcactggttaaaaccatcagtgtaacattgaatatagttttaaggtcattgcctgtttattataacattgttgtcagttctgggtaggctttcattaactggtttattaaccctcatggattttattttcttccatttttgcatgtctcatgtctgacaatttttttttttatttttgagactgggtctcgctctgtcacccaggctggagtgcagtggcttgatcatagctcactgcagcctggaactcctgggcttagtgatcctgccacctcagcctcccaagtagctggaactatggctaattttttgtaattttagtaaagatggggtttcaccatcttgcccaggctggtcttgaactcctgagcttaagcggtctgcctgtctcagccttccaaagtgctgggtttacaggcatgagccaccatgcccggccttgtctggtgatttttgattggatgttaggtcatttaaattttaccttattggatactggatatttttgtattcctatattcttcaactttttgttgttgttagattctgttaaattacttggaagcaatctgatcctttgaatcttccttttaagatttgtaggtgagaccagagcaacatgtagtctagtgctaatttccccactagtggcactagaacttctttatttctctactcattgctctgtgactcatgagttttttcagtctggctgatgcgagcaggcaatgtaactggccctgtgtgagcaccagcactctaacctcttattctttccagtggatgttgtccagccttgagtttccttttatgcatatgctgatcagtagtcagctgaatatttaaggagaccctctgaaaatttacagaattctctctctgtgaagttctcttctcttgtttgtccccccaggctttcatctctgtctccttagctcagggattccgctgcaccctgcttgtgtttctcctccctgctctgcagcctgcaaactgtttcaaggcaggaagctgggcaggtgtacatcttacctcatttgtttcacatctctcaggggccactgtccttcattgcttcatacccagggtcacaaactgttgtttcttaacttctggttgttttaagtaggagggtcatccctgttcatgttaattcatcctgattaaaagtggaagtaaacaatattgattgttagcattttaattgtattcagtgcaacaagatactcacaccacaaggggcatgtgggaataactcagagaagagcagatttctaagtacttgttcatgtcccatcctcattgagtgcaatgacagacagacatgttgacctgtttatattgtgttatattattattctatcattcactgactcacaccctcttagttcaattttcataatttaaatacaggtaggagtcaattcagctatacttgaattttttttttttcatgagtaggtgaaatttttgttctgtgctcctagcatttggcgttttacatcaggggttgcaaattcaaatgcctaaaagggacaagcaagtaatgtatgggagtgaatttggtaaggcatacaatgactataaaaatagcaaatggtgtttagtataaacgagaaagttggcaggagggcaggcagagaccatggccagttgcagaggaaagcccctaggtcaataaggcagttgcaacagtcagctggagctaattgttaaccatgagggaatgttccttttgcagaacttctgatttttcaaaagacatggaaatatagatttcagctatgtatgtatctcaatttttgaaaaccacttcaaattttaacaacaaagcagtctgtgaattaaataaaacttacctagaggcagcttgtaacccatgtttaacaatgaattgtttaactgttcacagttagaaaaatggaaaaataactgtttacatatagcaaaatggtttagaagatgacagaaactacttaactaggaacataacacatttgtgtgtgtgcgtgtgtgtgtgtatttcaagtcagtgacaaaatcaatgaattagtgagtatacacacacacacacgcacacgcacacacacacacacacacacacactctctctctctccctctgtctctctccccactgagtaagtgagcccttcacaagccttgggggcttttgcatactccttgggcacggagttattttggttcctctcccacataatcacttgagagactctgggaaggtaaaaaaaaaaatgcttccatgatcaaagctgcatgaataaatatggctgtgtgaacatgagtattttcagttagcttaataatagccatttctttaatagatatagagcgccttttaaatttataaggatttggatgtaggcctttaaaattaaactgaaactattttgaataagacagtgactaggatgaattgtaacaagaagataaatgccaaattggtgtaggtttttcttttcttgaaatgccagattgacataaacttcataagaaggttaattcttgaagaagaaggtttaattttgtatatgcctgctagattttggagattatttgacctattttgcattaaaaaagggtcaaaggaaaaaatagacaaactcttagcatgaaaaatgtttataggttataagttgaactaatatgtaagagaaaaatagtttaaaaaagtttaaataaaaggtcattttaagtaaaagttttcttctttcatatcattacttttaattatatacaaattagttgttaaatatacaaattgtttaacagaattttattttgattttatgtcatttatttctgtgaaaaatgttagaataaatgcttaaaagcagaaatctaagaattttcattaaaaagaataagcaagatatcttattaaacgtcacaaaaaagtgtcactatggtttcttttctcatagttggagcctgaatataccttatttacaataagtggtatagaatgtgagaaaaccacaagtgagttccattaatcctttcgaatccccaaagtaataaaatgaagcatgattataaatagaatgtcaaagccctagtgttttctgtgcacttgtacaaattaacatttatttggactgaagttttccattaatctgattcacccaattgttccttgtggttctcttaagatgaacatttgccatatttttgaagctcgattagggcattactaagtcagtaatttgcaagttaaaactgaccattatagtctgtcttcaacatgcaaggatcaaccgaagattaaaatcttaatgccttccctctaaatatgggtagtgttccagttatcttataaaaacattaagcaggctttgccttccaaagatgttttatattttggatacaaaatcaatacaaaggtgagatacaaccaatttgaattggtaaaatatgtaaattgccacttgctaaactgtcagagattaatgtctgaataggggtaggaagcagcgccaactgtaaaattatacagggcatggcgattaccccgtctgcataatggggcttgatttagaggctctattttgggatcacacataaaacacccaatgcagaaagccaacctttgtttaatttgtccagggcagtgccctagttttctacaacactattcacttctttaaaaatgaataacacattttctttatggatctctgtgcacctttggtttgcgagcagtagcttttccaagctcctctattagattcttcttttgttgcctttttataatgctatttctttttgctattttaaggtgcattgtctgtgttgcacttgcctgtgcatgcaaagtacaactgatactgtttttgacatggctaatataacattttaaagttgacagatgagaaaacaggaccaggaagtacaaggccacagaactgggtatggcatataggactctgttatccagtaagagcatgtgccacctaagtgggatgccactgcaggtacactctttggctgtttcttgagaggtggaattcatttcatttggcagtacctcggagggctttgtcttagatatggataacctggggaccgtaatacctacttcagattattggtactttatcattaaggtttagtctattcaaataagtacaagattcacttttttaaaaaagagataacgttaccatgcatttctgcagttttaaaattcatgacgtctttgtaaaatttttgttaatggcttctttttattttcacaggtgatttttcattaccatatatttgtattgcaagattctcttagttgcaaggatcagacacccaattcaagcttgtttaaacataaaattgagtccactggttcatattctaggtgggtccctggatggatctgagttagacacagctggatccaggagttcaatgatgcgaaggctgtctttccatttctcaggaaatttctctgtctatctctgtctttccttgtctcagtgtggtctcactctcaggctgacttcgattgggaaggaggccagcagcagctctgggctcacatcaccccagtccacaaccctgcatgcccatctccaggacattctgttcagccagtcttgagtttcctctgaaccaatgcttttgggcagggacatgagacactcagatggtcagcctgtgtcatgttgcatattctttgtgtaaagggggcaatgacattattcagtgttgggggcaaggaactgtgactgacagcctcattcaacaaggcagcatgcagtagtggagaagcttccccaaggaaggggacagaagagtgttccaaagcagaagcaggtataactctcatgcttttaaccaccaaaaatgcaccagagccactcagagttacataaaatgttaattttgccataggaagatgtattcttatagattaaataattcatcaagcaatccacattttatttccctctttaaccatcatcttttgacagtgggcaaagaggacaaagccattgaaggtacccgttttaaaggaatcattttctctgtttcacctcaaatattttcttagtctctctctagctttgctatagaacttctcacacagatttgcagttgtcattggacttaacagtctccatcaactgtgagaaaccctttcaagcagagactaatgttttatttctgttccagctgtgcctatcacagtatttggctgcatataggtgttcagggaaggtggaatgaatcagcaggcaaatgtgtggcacatgcctgcctggctggagaagacaagctcagaagagttaggtagctgaggttgcacaatatattgtgttgaagttggaatttgaactctgttatcttcctgtctccaatttagcttttcttttttctttttctgtttatctgtgtatttatttcacttggctccccagccaagcaatcaaaggggcaggtgtgctggtccacacctttcagtctctgtttgcttagtgactgaatcaatggttgcggcatttggtttacaacacggatgggaagaccatctcggaacttccaggcagtgtggttgtctcaacctcctgaaagcagggccacttctcgtgccctcttcagaaaattgctgtgtggcagaagttggattgatgctctgtgcttttatgaatgtcttgtagagcctgaggaaaatggcagacaggggagatacccccacttactcaaacctcacatttggagcttccctcttccttcatcctgttcctctgttggccccaatttctttcccaaccaacttggcaaaccaccttcagatctcactctcagtgacctatgtggctccttccagaccactgtcccctgttggcaactccaaaccctacactctgcattgggctggaatctattaggagcaaggacagaaacttccagattacgaagtttctggaagaaatacgaagacttgctcttacttttcttttttaaattcaagtcaaacactctggaaaacttaagggcaagtctcttttccattaaaaagaagttgccctcagagctggcaactttttattctacaaggtggctgtaacaattggggttcagccagagagacagaactagtaggacatctatatttagaggtttattcaaggaattggcatatgcacttgtgggggttggcaagaaaagtccaaaactgcaaaggagactgtcagaaagggtgggctggaaccgtgggctgaagctggcatccataggaggaatattttcttcttcagggaagtctgggctgcctcttaaggtctttgaaccgactgaatcaaatttgccctaattatctagcttactctcccttacttcaaatcaactgattatggactttaatcacatctacaaaatacctttacaacaacacatagattggtgtttgaataactgggcatggtagcctagccaagtcaatgctttaaatggaccaccagagaggccagatggagtcctagtggacttgtggaaaagacactttgtcttgccacaaattccaaaacttctactgcccttatatgagatgagctgttttgattcaggcatgcaacgcacaataataacatcatggagaatggggtatccatcccttcaagcatttatcctttgttacagaccatccaattacactcttttaattaattttaaaatgtacaattaagttattattgcctacaatcaccctgctgtgctgtcaaatagtaggtcttattcatcctttctaactatgtttttttgtacccattaaccatccctgccttcccccacagctcccccctacccttcacagcctctggtaaccatctttctactctctatgctcatgagttcaattgtttttatttttagatcccacaaataaatgagaacatgcaatgtttgtctttctgtgcttggcttatttcatgtaacataatgatctctactttttaaagaactgtttttggcagtttttactgaggcgaaggtacttgtgtgtgtgtatcattatccacttctttcagtcttgtgtttgtttcataaaccataccaggtccttaaggtcaacttggacgaagcagtgagctgatctagtctatgaatcctgatttagttttctttttttttttaatatttgtggtttgttttttaaaatgatgttaccttcattaccttccacaaatattcattggacttctgaaatgtgctaggaactgttttaggcccttgtgatatgtccttgaataaaatagtttctgctcctatggtgcttttatattctactggaagacaataaagtaaacaaagcaagtatataatcttatagtggcgataagtagggataaattataggaacaataaagcagggacaaggagtaggcagagatgagtatattatgtgtgcaaactggctacacaactcatagggcccagtgtaaaatgaaaattcagtgtttcttattcaaaaagcagaagaaacgtaccattgaaggtaccaaaacataaagctgttttaaaataaatctttgtctggaatagtcctggtgtttttaaaattattatttgccatttaatgctgttctaagtaaagaaaaattaaacatttagattctgagcatgaatttacattgtgcagtgcctactttaaatgcaaatgtaagggtgggatcatagaaattatccaatttgcattttctagttcatgctgtattttgtttttgtcggaacagtgaaaacgctgcacaaaactaacttacctgtttttatctcacttcttgatacgtgcactttctctcaccactttgccttcatcttactgatgagtaaggaaggactgaaaggagaaggaactgtgtctgcctcacctttccctttccttctgtgttatcatttcagtacgtaggtggttgccttgtacagggaagtaatacaagcgggaaaggatgtgataggattccatgatcattcctgtttcttagaacaaggctaatttctttctgaacttgaagcaagttctggttccaatgcatagcctcttggggctgtgcgtgcccctgcttattcaagtcttaaatacttaccttgtactcactttgactcttgctaaattcctacatgttaagagttgaacagaattctgtctttatggggcatcactaatgctctgtgaaggtgggtggtaaggatgggggatgcacacactgtatgtttcttatccactcacatctgtgctccactgtcccatcagactttccttacagaatacaagttcaaaataacattattaagactttttttttttttttgagatggaatcttgctcttatcgcccaggctggagtacagtggtgtggtctcggctcactgcaacctccgcctcccaggttcaagcgattctcctgcctcagcttcccaagtagctaggattacaggtgcctgacatcacgcccggctaatttttgtatttttagtagagacagggtttcaccatgttggccaggctggtctcgaacttgtgacctcacgtgatcccctttccttggcctcccactttcaagatggggacattaaaccaaaggcattgaaccaagtatggagtccttctgagtgtgaggccctcctaagcacaggctgtaggcacatgaagcgaggcatgagtctgtgtttgtgtgtgtatatgtatgccggctgctttatattttgatgaggaagggctgtctcatgaggtgacatttgatcagggacctcaaggaggcgaggaagcaagacttgcaaatacctacgacaggagcagcgtgatcaggggtcctaaggcacaagtgtctttggtttattctcagaatagtaaggaggacactgtgcctggacccctacatgagaggatggggatggaggatgaaatcagagaggtagtaggtccttgaatcatgtgtggtctcaaaggccaaggtaagaacttggaatttttccatgaggagatgggaagacatgggagggtttgagcagaggtggcatggcacaattagattttagaaggatctctctggtgacggtggggcaattctctgtatagggacaaagttggaagtgatgggaccaggttggatgtcattatcatagaccaaggaaagaggggtcttagactgggtggtatggatagcagtaattgaatgtggttggattctgagcatctttcacaacaagagccaatggatgttgcatatgaaatggatatttacctgggatcctggcctaagacagcagataaaaatggtctgtcctaaagtagtgaatttcctaaggttccacagccagtgcatgaaagagctcaggaaggcagagaacagaagtcttgtgtactttttcatctgttctccttctacagtgtctagacttttcccaaaataacccctataacatcctcttccaaacatcttatgtagctgaatctgcatggattccattgccacaatttcatctgtatacagtacgttggaagagcttctcagaacataatgtcctgggtgaggtgactttaccactaagtcatgtttctgtggactctgcttaggaattgactgtctccacagtttcatctgagtgacgtcctgacaggacacagttccccctcctctgttttactaaatatctcttggcctcccctaatagaacagagtcaataaaacaagttgctactgggtttaatgtacaattgcaggacataaaagtccaagtgattaaactacatgtggcttatttttctgcttttcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggtatggggcacgtggccagcaggggttctcttggtgagatagcctcaaagatgtgtgggcttgagacctatgtttcacaatggtaatcatttttaagaatgaaaatataaaatgaccaacaaaataaattcacagagtgatggtagactgaattcatatcctgttttatttttctaaatgacctaacactatcacttttggacacgcattaaagacctagggtttttttgtttttgtttttttttgagacggagtctcgctctgtcgcccaggctggagtgcagtggtgtgatctcggctcactgcaagctccgcctcctgggttcacatcattctcctgcctcagcctcctgagtagctgggactacaggctacaggcacccgccaccatgcccggctaattttttgtctttttaggagagacggggtttcaccatgttagctaggatggtctcgatctcctgacctcatgatctgcccacctcagcctcccaaagtgctgggattacagatgtgagccaccaagcccggcctaaagacctaggttttagtatatatgaataaaattgtattctctctgtgatttctgtagctctgtggaactttggagttcacaagaaaagttttgttcttaatgataattcttccctttgttctttcaatctgaataaaacatatcttgaagaatgaaaaaaacataaaaaatcaagttttctaacagttatactctccaaatcctttagggataattttgcagtttttgctttgcttcagctctcaaaatttatactaatattcatgcctcagaatccagaaaaagcattttcatttatgcaaactttaatgccaacgtggaaacaaaactagaaatgaaatgtataattttggtaagctttggattttttctcacacgatactctcttttgcttgagttgatgaatatagtaatcaatttagagatcacaaagaaaatatgttttatggatgttttatcatcagaaatttgttttgagtagtggaaataaaatcagagacaaggaaagtgcttttgtatatggatttctttcatagctttgtagatatactcctttccttgatgctttccttattgctttcgagatatactccttttccttattgcttagtgtgaaggaatcagttctcgcatagctgtggtcaggttggcgtctacagcgatcttgggtgatggtggtatgcacaaaacctcatccacattcattcattccacacatactcattgggtgctcactgtctgaccggcatagtgtcacagtgtgggcaaaacccaccagcatctttgtgggatttaactgctcactgaggggcatgggaggagaaaatctaggtaaacaagcatggttagtgagaaatccaatttgtgaagaacctgcaggagaatctttcaggcgaaagaatagggcgtactaattctatgaggtgggtggtcttggtgtgtttgggaacaacagggaatgggccagtgtacctgagaacttgagaaagttgtgatgagtggtggcgctgggggtggggggaaaagagtcttgtggtcatggcgagaagtttaggtttcattctaattatgatgggggaatcatcagtggaataaggcaagtgagctatgtgactcattttaaagtgattttaaatggtaattctgataaggagaacttccaacttcccaagagctattgtcagtggctctgccttaacaggagagagtgaatcaacagaactggcgttaggtacattacatttaatgcttttggtgaattgatgatacaagggaattataaatttgaaagtgatatgagatcaaattcgttatacattcttcaggagatttattaatgctattttgatttctgttcctatgaggaaagatggtgcctcaaagcaagatgaaatcagtagggacaagtatatggaggagaattaagtgtgataaagcctataaagtatgtttaaaacgggaagggcaaaaactacacagttttaaaataaaaatacctagcaatctaacaatctaatgtagatattaaataaatgtgtgtgtgtttgtaagagagagaaaaatatttgctagaataaaaaccatcatttttctgaaaaggattatagggttcatgtctcatggactaattttttctgtgtgctgccttaggttgtactcatttattttacttttaaaaggacgttgaaaaaaaaatagtaggaaatcagaagagtgtgccaaagagggcaagggttccgctggcctcggtatgtgtggctagctagacaaaggaaatcgacaatgatttcatttggacaccaggaagaacttctgcattcaaggagaaaaacacattccaccgggctatataaagtttatggactctccatccctagaaaccttgaagaggcgattccaggcatagataatcatgaccctggagtcaggaatctgggccaacacctcttgagggcttttccagcgttattattctatctgaaggaagaaaacctgcaacgtgtaattctccaaattgtatactattgacagaatacacttaagttttgactggaaacgtactggtgttttattctttaattctcaaagacagtgtcacttttgtgttctgagttttgttaaaaaaatctatttgaaccttgaaatgttggtttaaaatccttttagatcttccccaattttttctgatcatcttcaagaacaaagtccagtgtttcctctctgattcttgctagtaacttagctcacaagatgccagctgcagaaggaacgctctctcgggctcacgcctcccaggaataatgaacacaatgtagcccgggcccagctgcagggccagctcacgggaccctccgccttcacacagtagtcactcttttttcctaatagctcttataactttgggtttggggagggaaagaggcaggaggaagcaaaggaaagggggagttgaaaatgggttatggcgagcaccactgagaccctagctcatctcagatttcccattttctgctgatctgtattctccgtgggtcctgacgggattgccttgctaggctattcatgtttcgggcagctgggtctttgtgtgttctcctctattgctgccacttttttttttttttctggagtagagttatttaactgtacaacccactgcagtgcattaggactcttgttggagctgtttggagtatcagacgctgtgtgtgattttgctgcagcaatgatggcttgtcacacctttctcctcctatctagcaagatggaatcctaggtggcttcagcttgttagcaaacatttattgaattagtagtcattgaaaacctactgtgtacatggtattgtggaaaaaggaataaaaataggtattgtgggggatgcaacctatagccaagtagaaggaataagacaagtgcccaaataaataaatcacaagtacttctgaaacttgtgtgagtatcagaatcccctggcaagcagactcctggaccttcttcccagaaattttgactcaggcactcagcttagtggtggggaacaggagcctgcactttaaattgtaccatgtaattgacatgaaggcaaaccgtgtttggaggttgaagttctgagctgcagagtaatgtgacaagagcaacctgagtgacatgaacagacccgtaccctgggaggtggggagtgggatggaaaatgggatttggtggatttgctatggcagtccagaaagctgacttctaaggaagaactgggctctggaattactggatcagatgtgagcactgtgtgtgccaccttatcctccagcaggagctgccctcctttcattgagacttgcagggccattcactgatgtcctcaaagccttcacaaaatagtgataataatgatgaccatagtaataaaaaaaaatagctgggcgcggtggctcacgcctgtaatcccagcactttgggaggccgaggcgggcggatcacgaggtcaggagatctagaccatcctggctaacacgttgaaaacccatctctactaaaaatacaaaaaattagccgggcgtggtggtgggcacctgtcgtcgcagctactcgggaggttgaggcaggagaatggcatgaacccgggaggtggagcttgcagtgagccgagatcgtgccactgcactccagcctgggtgacagagcgagactccgtctcagaaaaaaaaaaaaaaagaaatagaagtcttaataacacagaactgacaataacacagaactgacattaaagaacaggtgttaattaatgcattaagcactcatctatgcacttttcatggcatagagccatttcatcctcatggcaactcaacggtttaagtgccaggtgtagccccatttcacagatgaactagttgaggcatagagaagttcatctgactgtcccagggtccctcgttagtaactagcagagcctggatttgaactgcagcattctgactccacagcctgtgctcccccccaccggattccactgccattgggtgggttttgtgtctatccacaggtgcctcttgaaacaggtggggcagttgtgtcatgtgattttgagcaagttgtttcttttcttcaggcttctgcacctttcataggtcagtatcaggatctcatggactatacaaaattaaaaaaaaaatgtaagggctagttgatttggcaggtgagttgttacacactccttagtggattctgagttccgtgcctaccatcccatcctgctctctttcatccagacatccaaggctggaggatttaccttgtttaattggattgggatgttatcttttcttacagaaaccagaaagcataaggaaagtactaaaaatatcatatgattttaccccagatataccacgcagattctcaaatttggttttcttaaaaaaaaaaaaaaggcactctacaatgaaaaatcatatgccttataaacattatatgtgtagatatataaccaacacaaaatgcccaccgagttcctatatggccgtgtggatgctgtacaatacccgttccacagtgcttatactgttaaagcaaaatagcagcaatattgtaacaaacaaactgacacataactggggatttagcacataacatatgtcttttatttaaaatgttttataaagtttgtaattggtgctaatttctgagcatgaggatttctctgagttacaaaagggaagtaacccagaagagaaataccaaggggaggtgtgtgtataggaacaggaaaagcaggatcattagcagttgttgacatgggtctcctgtttgggactgaatctgtctgccttgattgggagagtacatcgctgtctttccacaacatccttttcgtatggctggtggggtcagcgtctgaggtcagccctgagggttggcttcagggggttgcttctcctggcccctgaggcaaccttggatgtccgaggtgaacagggctaatttagcatgacctcttgtcttttcttttctttacttctttctttctctctctctctcctttttttttttttttgagtctcactctgtttcccaggctggagtgcagtggtgtgatgtcagctcactgcaacctttccacctcccaggttcaagcgattctcctgcttcagcctcctgagtagcttaaattgcaggcatccgccaccaggcccgcctaatttttataattttagtaggagttttcaccttgttggccaggctggtctcgcactcctgacctcaagtgatccacccgcctcggcctcccaaagtgctgagattatagacctgagccaccacccagccagaatgagatatttctttgtgctccccttcctttctgttccctcccagcctagattgaaggtgtccatgtcttgattctgcagcctatccggcagcgcttgttcctttgtcctttgccgagagtcccaccagcccctcacctaggcctgtgctcaccatgtgcttggccccatgtacccaaatcttgtctcctcttgagtgaggcacttggcctggcttgatgtgaagcccagtctaaagccgctacggtcatcttcccatttatgagggtaactgtcaaacaaaccagtttccaagaaggagttaatgatctgtaaaccataacaatttttatattgccttttttgagattccttgccttcaggtataacagtagtagtcccttagctctcaggaaggaagagattgattacagtttcatagaagggaggggagatgtttctgagctgaagactttgcaggtaacccttaaatactatcagggggtgcttgtataaaacagccagtcttagaaatgaattccagtcatccagcttatctcatgataaggactcttgatttgaatgtaagtgtatttgaaattagcatcacatgtatctgatttctacacctaaatctttgggttccgttgatcaattatgtatttaacttgaaatacagtcatgttttctcattttagacaaagggccattttttacttcttaacacaaatgaaaatattagttttattatgtgaccaccctcatcacatgcatctctacagctctttcttggtgttggccatttggggcatttcttgaatcctatgccaattatacagactttcttttgcaaagtaagtttctgactttaataccaagacagaatacaaataatattctataaaatttacatagaatctaatataatatatatatatatatattagattcaagcctgtggtttccattgatattttcatctaaattcagagtcattgatatttattttctctttattctttcttacactttcctgtaaacaaatcaaaacattcacttctgcttgtctcctcaaatgcaggaagctaaaagtttatatgagctaacctttgttgtttcagagacaagcttttatttttctgcaatttttactctttgtagacttgtaaatatttttcctctctctctcccttccttcttccctccctccttccctctctccctctttccctccctcctttccttccttttttcctttctccccttttttcctccttcgctttctctcttcctccttcttttctacttttctttcattctacatccacaagaatttattgcacactgtcaggattgtacacttacatataaacatctacctgcctctgatatttaaggaccaaggacctagcagaatcaatggaaaaggaatattttgaaaaccggaggaatctcctcgtccccagcaggaacttaagccacgctcagccttgctcctccctcttcaccctgtccagtgctcattctcctaacctccttgttccagtggagtcaggagagaaagtggatatggctccaggggtagctgaagcctccatctattgttttagtgttgatctttaaatatatgttcaaatacacactccttatgctactgctagtgtacctagcgcggaaggatattatacatgtggttttaatgtaaacttcttcaccgcaggtccaaacttacaacttcgaattctatactgtggtctttccaccaacagccgtggtggctttggcaaagctctttatcctttgtgacctcacttttgttatttattgactaaaatcttttcatactaggaattaaaacttcccagctgatacaggtgtttcaagtgaagattataactttgcctgatttatctggtttgccacatagaattggcccttgcttaatgctgttgagttggatgacagacttgtttatggggtcactcttatgattggtgggtgcagtagagctgttgtcccatggagggactctctggagatccctgaaagcttccaactacttatttccatgtgccccatacactgtgagggctatagctgtaaatcgtggtccttttactatagagaatcagatttgacattaaagcccaacttttgggcaaatgacaaatattataattttcttactgacaaaattagtctacttcttgattttaaaaactcctgggggatcagcaaagattcattagtgaaaaaatgggaaaacctactaagcgtttaaatgtatgaaaaagataatatacaatttttattcagcaatactatggaaaatatgcagtcatcaaaaattttgttgtagaaattatattgatatggaaaatatttataatgtattaagtatataaaaaagttgattataacatgttattagtatccatttttataaaataatgtaaaataaaataattatatgtagatatttgtaatagaacgctggacagatatactaaaatatgaatagaagtgatccctggataataaaactagggatacacttttgattttcctacttttttgcttatttgcattatctaaatttttaatgctgaatgagtaatactttttaaattagttttaaaaagtaataattaaagaaaaaatttatttggatgttaaaagtttgtctggaaaatttataggaaactccattctaaatggaacattttgtaaaaagctgcaagtcggtaacttagacatttatttcttctctgtgcccaaacagaatttcataaatttcagggaaagtgacgtttttccatttaacttgtgatttgtctggtgtcagacttgcctcatgtgctcagcatagtaattgtaaacctactcaaacacatttgaaagaatgacatactggtttgctgaaggctccttcctggcaaaattagtggcttaaaacaacagaaatttactctctcatagagctagaggctggagtccacaatgagcatcatgggacagaaatccaggtgtcagcagggtcatgctcccggaggctctagggggacaatccattctttgccccctgcattttagtaggctgcaggcattccttggcttgtgggtacatcactgcaatctctgcatggtggtcacattgccttctcttctgtctctatcaaacctccctctgctttcctttcttataaggacacttgtgattggacttagtgcccgttggataatccagtaatctatctatctaggatccttcattttatcaaatctacaaaaagcctttttctttgtaaggtagcatttataggttccaggggttaggatgtaatgtctttgggtggccagtattcaccctactacagatggttctcttataattggggaattgtaaaaatgcaaaaattgtcaaacacacacacacacacacacacacacaaaatgttcacagttcataatttttttttaaaaatttactttaagttctgggatacatgtgcagaacgtgcaggtttgttacataggtatacatgtgccatggtggtttgctgtacctatcaacctgtcatctaggttttaagccctgcatgcattaggtatttgtcctaattatctccctccccttgcccctgaccccctgacaggccctggagtgtgttgttcctctccctgtgtccatgtgttctcactgtttaactcccacttatgagtgagaacaaatggtgtttggttttctgtttgcagcactatatacaatagccaagacttggaaccaatccaaatgcccatcaatgatagactggataaagaaaatgtggcacatacacaccatggaatactatgcagccacaaaaaagaatgagttcatgtcctttgcaagggcatggatgaagctagaagccatcattctcagttcatcagttttttaggttatgtttattttttcttaagcctaagaaaattatttccttggaattcagaaagctactaaaaaatcgaaaaataaagaaaattgctctgtaaaggtagcatcttactcatatgttgagccaaattcattttttaatcaaaatttctgaaaaagaagagatactttaacattttatatagaatataggtttttttacacaaaacctgtggtttttttaacctgttctacacaggttttgtactacaaatattcacattagtagtttgttatcttctaatatagtgggcacatgaaacagtgtttgtaaaagattcacggtactgtcacagggacagtgaatagatacttttctcctcattttgagtaaagcttagagcataagtttgaaaacgatgtgggaaatatgagtataatatgcatgtctgagagaagtacctttttatgcagttattttccccttatgatttcctgttaagagagttcatctttgaaataatttgttggtttagttctgaaaatttagtttaattattatctgaatttatggtttatttatctagaaaaaaggttaattattccacatatttttctgggttggttttgtggataaaatatatttccactatggtagacttcatttgttagccaaccatagaaacactccacagaaaactaattaagttggtagaaattcattaataatgtgccttatggtttccagtggaaattgtataacttcttagagactctccaaagattataataacttcaaaactaaaatctggtttatacaaatatgatacttaaatataagatgttaacttttaaaatgctgtctcgagtttatatatatatatatatatatatatatatatatacacatacatatatttaaactcagcattcgttatgtcattcttattttcaatgttctattcaccttttgcattaggggaatctgtactgagggaaccaaatgtgagaacaagtctacctgctactccaagagtagtgtaatttattgtttattaaatgaaaaaaatatactttaggtacgaaagcattaaacaagatagacggtgagtgtaatcttatataaacctagactttccttgtaagtgatttttttcccttgagttttaaattgtatcaaagcaatacttgcagagatgaaaacatcaaataacagtgaaaaaaactaaacataaaatatttttagctgtctctttcatcccttctgcacacctcagtcctgcttgaagaagtgatcgtaattatttattttggcagtttcttcttgtgtttacctttacatatccaaacactacactttatcccattatgatagataatattttttagctttctgttttggtagatgtagatttaggccaataatgactatactcactctctttcctccgttttgctagtatagttacttctgaaagtttagtgaactcaatatctgtgtgataactaaagggcccatcagtgcagcataatttttatttcctttattgttcaatttagaatatatatttttagaattgtatagttttatatacacctacacttaattttccacaaatgctttatcaaatttggcgtatgactatcaatatgttccccagctacccggttatatgacatagtgtattcttcatctcctcctggggatctcaccctgagagttccttgtcctcttgttcctgagtagactctgtctctgggtcagctgcgctccttctgtaagttagggacttctctctgttgctctgctgtgttggatgctcctctgttttcttccccttttttgctttactcctgtgttatgctggagcacgtctcccagaagtaaacattgtgtgccttttatatctgaaagtttctttattttactctcaacttttcaccttttggctgggtatagaaatgtagactggaattaatttctactaagcactgtgaaggcactaaccattgacttctatgatcccttgttacatttcaggaacctgatcctatttgattcagatattaatattcttttgtatgtgactttcccccctgtattagtccattttcacactgctataaggaactacctgaaactgggtaatttgtaaggaaaaggggtttaattgactcacagttccacacagctggggaggcctccggaaacttaaaatcatggcggaaggggaaggggaagcaaggcacattttacatagcagcaggggttggggaagtgccacacttataaaccatcaggtcttgtgagaactcactatcacgagaacagtatgggggaaacggcccccatgatccagtcacctcacactaggtccctcccttgacacatggtgattacaattcaagatgagatttggatggggacacagccaaaccgtatcatccctcaacactttgcaagctttaaagatctttttgtttttggtcctctttaattttatggttacgtgccttggtgtggatgttcacccacttcatccagttaatggttgtgggcctttttaatttggagactcttgtttcttaacagttcaacaaacttaaggaaaatcctgacttgccctcctaatttgggaaccatttaagatataaggacagatgataaatgtagattaggtcaaaatatcagttttttaaaaaattttattattattatactttaagttttagggtacatgtgcacaatgtgcaggttagttacatatgtatacatgtgccatgctggtgtgctgcacccattaactcatcatttagcattaggtatatctcctaaagctatccctcccccctccccctaccccacagcagtccccagagtgtgatgttccccttcctgtgtccatgtgttctcattgttcaattcccacctataagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgctggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccatactgacttccacaaggggtgaactagtttacagtcccaccaacagtgtaaaagtgttcccatgtctccacatcctctccagcacctgttgtttcctgactttttaatgattgccattctaactggcgtgagatgctatctcattgtggttttgatttgcatttctctgatggccagtgatgatgagcattttttcatgtgttttttggctgcataaataaatttgcttaggaaaatgtagcttaggtatgtagagtcagtgggctttctaaaactgccatatcttggttgaaacccctgatatgttactgtcttctctctcattgattttttcctttccatttacgactgaatgttttccattatgatcaatttagtagactttgagaaggagaggcgatacatattgaaggacaatttgccatcttttcccagaaatcctctctggattgttaaatcctctctaacttgctaattttagccatttgaactttcctttcttgtatctttatttaagatgaagacagtgacacttaagttactttcaagtttaaagagatatttataaagtacttcgaacttttttgtgggagcagtactatataaataaaatactgccattcaaatacagcccccgccccaggtttgaatgtagaggtcaatgaactatagagaaaatggtaacaaataagatatgaccaaaaagtggcaataaataacacggggtcataaaaatttcataaaatcctcttttaaatatgaagggggattttttttttcattacatccctgggtgtttcagctcctgactatccagctagtagaatataaaaaccactgtaacaacaggtgcagatgtgttcctgggtgtgccagttgttcatttctttgtttttaatgaaaatatacattcgtttcttggcaagagaaatgatgtctgggcttctgtgcgtactgagtgctctaaatgagacattagtcagattggcatttatgagtcaccaggcatcttcagaagccaaatccaggaattataaaataatttactcaggaagtaatgaggataaatgaaattcatcatcctgggagccaggaaagttaccctgtaagctgaaaatcccactgaaattagttccccccccacattgattgatgaatgcattctctttaagagttgttttcgtgacacttatgagcagtgctagaattctcatgtttccacctagtatgcctgcaataagtgttagagcaggagtggtgccatccactattatggaaacactttcctattagtctattcatgaggtggtgcaaaacaggtgcttacttaccagacagctcattcagagtccaccttgcttgtggataaaagtcccttttcttctgttctcccctctttattctccttccagagatttcctaaagtcttttttacttcttggcccttccttgcagccccatccccaacaatcctggtctatcaggaacatctggtttggaggtagaaggagctccagggaaagggagcttcaggatcctcagcattaatcatcaataggagaaatggaccttagtcttgaagattaaaaaagaaagttttatgttgcaaaaacgtggtgtcttcatagttactatgccaacagaaccctaattttatttccgcttcatagcaagggtcatcttctggaagagaaagagcagagaggaagataagtcatcctgccacatagatactagagtcagtctgagacaaagagagtcaaaggaaggaaatgtgcagacctattagggcaatgcaaaaaaaaaaaatagtttatttgttcatggtcagtaaaatcctctactaggaaccctactcattttttctttttaaattacagacccctttaaacaaaagaaacactactgataattataaatgtattaatacataggctaaatcgctgtaatagttactaattattaaatatatatttttagagatagggtttattatgactattttaaaacaaatataaagtagaaatgttggcatgagctacattaggaataaacaatattgtatgtatatcttgttattatgatggatttctcttagtgtaggccaggctcttctttaacaataatggatataaaactgaatttcacatagctttgatagttttaatattgtttggctgacttcttgtcagatgcaattggatcatcagttttcaccccagaataaggtagaaaagatcatatgccaggagaaggaaatacatcagctctaccattttcttgtgtgtgtgtgtgtgcactcttttaattaccttaaatctgtcatttatttgtaggaatgtcagcaggattttattaaaaccagatttgtaatccataacttcactgcagtgagcgaatgtggactgtaaagctctgagtgatcccgcaggtgaagtgtcccatcaactcctttcccactataggatgcccaccctcccttaggatacttctaattctgtatgtgacactgattatatgacaaatggattggtggaggattccagtgtcggcctatgtattaagcattagtaacgctgaatttatttcatatttttgaagataaaaataactataaatagaaattttaatatattctgtccacaacctaggtgattctattatgtagcttccggggtggacatagcatactttggggatgaggtcctggagtaccacgctaaggacatggaggctgcttcttggctttgcagaaaagcatgccaagctcattcatgaatatctgctattgtttcaggaggagaaaatgatagactggtgtcagatatcctgatcaagatcaaaatcctctcttggcccccatgtggagggtgagaaaaactagacctatcagaccaagtgatattcttagcaaacaggtgtaggagcagaactggtatttatctttcttcattcttgggccaatcctccagtgctgagactgttcctccttattatatcaagggagagataaggagagaactcatcatcatttgtgtggatgttaaagacattaaaatgaaatgtagcttgtgtagctttggccacggtctgagatttattgacaactagcagccagttatgatagccaagatggttcattagctagggcagactctacattcgtagatcaagatttctttgtagaaaggaaaagtgactttctcagtgctgggatattcagatttaggaggcttttttgttcgttgtttgttttttccttgttcagtagttcacagctagaagagttcacatgttcctagaggataaagatgctaagatcagcactgtgtgaaatatggaaaatcttagattctgtgggtggggcaaaatgtattttcattgtatttgtaggatagattcttcatctagctcattaatctgtagtcgtttgtctttaggctgcagcatttgactcattcatgattgtgccatcactgtgaaggaagtgccatttgtgacactgtatccctttttctttcttttaagtgtagctaaagacaggttaagtgccctatcatggtgaagcaaaactaaaaatacatgtattccaagggagtgtttggtcaagggaagctcgcttgctcgctcgcttgctttctttctttctttctttctttctttctttctctttctttctttctttctttctttctttctttctttctttctttctttctttctttctctttctttctttctttctctttctttctttctttctttctttctttctttctttctttctttctttctttctttcttctatttttttctatttatttctcttttcttcagtaccccttttctcttacttctttcatcccctgtccattacccctctgtgctcttttccccacccgctttccatttttttttcctccttctacattcgtatgtctcatctgtccagcaaaagcactgatggttctttgatttgatgggtttaagtaacttgtctagccccaaacaaatcatttcggtccaggaagtgaaatacactagctggggatgtttcttctgtgatggagccaggcatggggtctgtttgctcaaactatgtggactcccaaagggaaatcagatatgttgggaatgaagaagtgagggaatgaacactggagaaccaaaaaattactgtctacaacaaatatgatccattttttctgaggagggagtccttatacatatacattatacaccatgagaccacaatgtagaacattagaccttgggccactgggtatcttgtttcttttccaggcttggttcagtgatcacccaagtcaaatgggtattttactgagtactagagggaacgcagggacttctccaagacgttctcggtacctatattgaagagcagggatttcaatcagattttggtgatggacagatagaagagggaaactgcatgagttaaaatttagtacaatttttataagcactgagtgtttttagagcacagtttttacagcagatgtgctagcttttacacctggtgatgtgagtatcactgctgttttcttcccccttctgagggtccaggagagaaggcagggtctgctccctgatttggcagtgaaggctgcatatcagacagtggaacctgcaaatttgctgttatttatcgcctagggatccaggaacttgtttgcctttctctaggaatgtggtttctccattctaccagctaagggtccagtgttttctggggaacgtagtgtgaagggaatctatacccctttgttttaatttggccctctttgaacatctgcacaaagcaaaatcttcacctgttctacgtagggaactgtcgatgggtttatttgtcatctgcacagtctctcttgtgaatattccagtgtctcaaacagaacaatggggagttcattcagtctgctttcaatggccttgatgtgtgtatgtttaaaaattagccaagcaaagtgcttcatttacagaaagcataactcttagtgctggtttatggagcttaaattacatgcataattgaagcagatgcatttgacataaattcacctattctgtgcacttctaagtagaagagtctgcttatctttattgttactttatttatttttgtaagtctttcagcacctagagattgatttactttacagtgcattacctgccttcaggactttgttcatttctttgccttgattcatgaaatattttattgaaaccattagtatctaattggaaacatcagattgaatttagtgtccttgatttgaaatgtagtaagtattaaacgctagtcctatggtaagagataaatgtcatctttactgtgagaaattaacttaaatatgttttatggtaaagagtgataaaaggataagtagggatgctctattttccacactcaggacctcaagtcctttttgttaaaacacacatgtcacaattaagctacttactcatacaaatgagtgtagcgcatttgacagaaatcattctattctctctgctcttttgttcctgggatcctctcaaatgtattaagcagagcagctatttatgaggaatcagagaactgcattcctcaatgcggtttattttacttgaaactgataatgtatgcagagattttgtgattaaagaaaatagatcatgaacttgattttattagtgttcttaaatgtataaaaaataaaaatagtctctcatcttccctttgcatttctcccgcattatgatgagcaaagtaaagcttagtagtaggaaatacccccttgccttaagggagttggatttttctgctgcatagactttagtttatggctcatttctccaagagaaacatgtttaccataaagatacgtggtaagtattggcatagaatatatgaacctgctacttagtgttctccatcagtgctgttgtccattacggctgtgaatagttttaagttaaaggagggcagagaatttcaagagaagatttgtctgaattttctcaggggatgacatagcactaataatttcctttgtcaatttgtgtccctgaggttctggataactagtcaatagattgaaatcaaagagagaaagtgccgttccttaattgatttttaatggagggtaaacagttcattatccttaattcagtaaagagcagaagttattttcatatgtaggtaacttgtttagaggcattaatgtatggctaagtttgagagggggaaaattacacttttaaaacaattatctttgtctggtaaccagtgaaataccagaaaacactgttgtaccagttacatattgttgcataagaaattaactcaaaattaatggcttaacacagtaaacattatctctcagtttctgtggttcagtaatctgagttcaggttatctgaccacctgtgtctcggggtctctcctgaggttgtggtcaagctgttggctggggcattggtctcatcagaaggctcaactgaaggagactccatttctaacctcgttcaggtgattgttggtgggacccaattcctttcaggttgttggactgatggtttcagcttcttgctgcctgttggccagagatttctcagttccttaccacaaaagcctttcctggagcaactcaaaacgtggcagttggctttcatctgagcaagcaagtgagacagcaagagtgagtgagcaagacagacaacagagtttttttgtaacctaaacttagaagtggcatcttagaagcaagtcataaccaaatccatcttatactcaaggcaagagtaaaaaggcgtggattttaggtggtgagccaccctaacattgtcagaagccatcttagaaactgcctactatgtttactgaccatgttttcagacctcattccattaattaatcaacaagcacaaattgagcatgttgctaataatctgagttctgcatgtcacatgattgctcttctcccctcttaaacatggcctgtccttagcttcaagtctttttttctgcccccaggttccttctggacatgacatgtttttatgccgtgcatcactccccatccacacatccctcagtccagcgctgttttggataactggatgtactgaacagtggtttttctatagcctcaggttttactgtaattttatctgaacctttctatacaatactttgcatcagtgccacccagggagaatgctactgttttcatacaatagtctatctgggtgtacatttgcagaccccatagctctcacttcacagctatgatgtatcattgtttttctgtaagtgtaattctgtctctatgaatttgcctattctggatatgtcatacatatggaattatgcaatttatggcctcatgagtttggcttttttcacttagcataatactttcaaggtttctcactttacttttacatgccatttcacgaatgcatgctagtcacaggaagaattgaaagacgataacttgaagcatatgccccctgaatggtggacaagagcattgtcatctctgcgggggaacaaaccacgtgaacgatgcaaaacccaagagaaaagcaagtggaggctttgccagtcaagttcatttctagattagcctctactgagacaagacccttccacttcttccctccatcattccctccttcctttctcacatctttccctcctcttctctttcccatctcctcttatttttgccttctctctcttattttctcctcttctttattccccatcttcgtttttcttctttgtttcttcattctctcttatgttccctttgtgtgagggcagaactaaaataggttagtacataaaatttctatttgtggggatttatcccacggacatagtaaaagtaatatacattaacctgtgatcaggtgaaaagttcaatatattgacataagagatcagctaaaataagtatggcatatctcttggaaagaatactatatagtcattaaatcatgcttaatactgccacatgactctaagattttaataaatcaaatagtattacatgtactctgcattcatctttatgccaaaaaaaaataaggtgatacccttgaagttagaacagttattatcatagtatgggaccattcctggtggcttttatttttctttgtactttttttagcttcaacatttttcaacaatgttcacgctttaacttttggaatcagataacaacagtggccaggtgtggtggctcatgcctgtaatcccagcactttgggaggccaaggtgggcggatcatgaggtcaggagttcgagaccagcctggcccgcatagtgaaaccctgtctctactaaaaatacaaaaaaaaaaaagccaggagtggtgacaggcgcctgtagccccagctacttgggaggccgaggcaggagaattgcttgagcctgggaggcagaagttgcagtgagccaaaatcacaccacaccactgcactccagcctgggtgacagtgcaagactctgtctcaaaaaaaaaaaaaaaaaaaaacacaggtagtaaacattgttattgaaagaatgctagtggaatagttcagtctttggcaatgaagccagagatcggcctttagtataaaggaagatcattaggtgactgatggttctcaaatgggatgattttgtccccacgcaggggacatctggcaatgtctggaggtacttttggttgtcacactagggaagtgatactagcttctagtggacagaggccagggctgctgctcagcattttaaaatttttacaatgtatccttctctccctagttaagaattatccaactcagggaggtgggagggatagcattaggagatatacctaatgctaaatgatgagttagtgggtgcaacacaccaacatggcacatgtatacatatgtaacaaacctgcacgttgtgcacatgtaccctaaaacttaaagtataataataattaaaaaaagaaaaaaaaaagaattgtccagctcaaatgtcaataattctgagattgaaaaacctgctcattggctggtttaaatattttaagttatctcattggctcatatcaatggaagaggtcaaatcagttgagttgtcgatattgggcatgaagaattaatttactttcaggtaacctgtaacaatatgctgacctaattatcgaaggatttgagatgaaatcaaacttctgtactcttacatctgcaattcacatagttttcatctgggttgtgtatctcaaagggaagaagccaggcaataaatttgaggttagtctgttgatactaatttaggtcacagaattccgtggaagaaattggtaaaggtgattgccgtaggaggactactcaagtcacagggaatgaagagagttctggctgagggaatagtgccacctactgaattgtgtttgtgttttctacaggttctaatttatgcaggcttatgcctggaagtgttactttcctttattgatcttgcacatctccttaagtagtcactgccagaactttaaacaatatttagttattatcggatcaaggtgtaattagaaacagctgtgaacaattgcataccatccagctcctgaagtagcaaactaaattgtacttggccttggattgattaatacagattgtgtctagcaatcaaaataaatccgtctccaggtagagtgccaggagccatcttaccaagataacacagaaagattaaaaatgcatgaaatgcaccatttcctaatgtcgccaggttaaaaaaaaattaaagcacaaagcattggctacaacaaaattgtcaacatttttatcctttttcaaaatttcagccttgatctttactttgtgtatttatgaaagcatatttagaattctctcatctttcgcctaagtatttaaaaaaaatctctacagtgcagtgcatacattgtaatatacctatttaataatgacagcatttttagttaatttgaaaaatcatttggaattacatattgaattgggtgggtcagataatttgttaccatggtgaatctcttcattggaattaaagagtttgtctcataaaattatatgcctctgtgtaatatgttaattaatgctcctaatcaaacatttaattacataatgagcctggattaatttgtaacctgaatctaaaagctaattcatataaaattcaaaatagtatgtatgagagagaaactaagaatttctagcacttgaaactttgttttgaagttctagcaatccaagccggtaataagcagaaggacttctggccagtttcaaggccagaaaagccggcagtgatagtgacaccgaaagctggatctctcatgttcttatgctgaatcatgtggttcgaaaggcagttttataatgtcgactgttttctctgggatcgtgatagcccatcctgtaagtacaaaggagccagagcttgaaggggaccccttcttcctgatgtcacacatggaacatagatggttgtggtcctcagaagctcattggagccatgaccccaaggagatagaacaaggctttgtctattaattctttatcccctgagataataagtgtatccttcctttcttatagccaattttaagccttccatctcccagaagtgagcagtctatatacctttaaaaggagatggttctaccacgtgccatcatctggagtccctggaaacaaagaagtgaatattcaagaaaccagatgcgagaactataaagattgttactgtctacattgctcttttctaagatagcttaatcctgctctagagagggtttgctcccagacagaaggatgatagtactagatcataactaatcttctgcccaccctcatgtcactgttgtttaacaatgactgatattgagataaatgaatatttagcacatctttccaccgagacggagtcttgttgcatttttcacaaaacaaacgcttttaagaagtgaacgttgcttggctgatcttcatcatttattcaagctgaaatcttggtttttaatttacaaataggattaattactgaaattcgtatctagtgtgaatatttgatgatgacttttggaacaatggacattttgcctaagctatgaaattaattattaatacttctaaactttagccaaaatggtgattttcacatgtggagattctttactcttttcacatgactttgttctcatagaaaaatgtggctggccatggtggctcacacttgtaatcccagcacttcgggaggctgagatgggtggatcacctgaggtcagaagtttgacacctgcctggccaatgtggtaaaaccccatctctactaaaaatacaaaaattagccaggtgtggtggcacatgcctgtagtcccagctacttgggaggctgaggcaggagaatagcttgaacccgggaggtggaggctgcagtgagctgagatcgcaacactgcactccagcctgggagacagagtgagactctgtctcaaaaaaaaaagagaagaaaagaaaagagaaaagaaaagaaaagaaaagaaaaatgtagtatttatttaaagtgtttatgctccgatgttataggctgtatcgtgacccctcagaattgaagtcttaaccctcagtacctcagaatgtgagcatatttggaaatagagtaactgaagatataattaagttaagatgaggtcatattggagtagggagcgaccttgatccgatatggtgggtatctttataaaaagtggaaatttgggcacaggcgtgcacccagggagaatgccatcatgtgaagattggagttacacagctacaggccagtaactgccaggagctctgagagaggcccagaacaggtttttccctagccctggcctgccaacaccttgagcttggatttctagcctccagaactgtgagaaaataaacttcatttctggcagacccaggaaataacccatcagacattgcagacgttgccactgagtttagctaacactgggggcatctgctttgtatcagagccgagctaggtgctgatgacgcaagatgaattaagccctccaggaacacagtctagtgggggaggtgaacagacatggattgagaactttgacgagcctctaaattcatagtcaccagcttcaactagacccatgaaactgcctgacaagcctacgagtttcctcattaacttgctccgccacatccctcagtggctgttcaaatcaccactcaacaaatgatcttttcctatctctcatgtggtagttttaaaaaataatttatttaaagacttttctatgttttctttaaaaaagtaaactcagaactttccagaaaggcagagtttccttttcttgctgtcactgtcccccaggcatcactttgcgccaagcttctggtctctgagaagcgctgggacttgcacgttctgcagtgaaagttctgcctgccctgagaatgcaaggacgggtgtctgcagcattccaggtgggctgagggctgtctggctctccagacaactccttatcaatgctctttgtgacacagagagttagtcaaagttgtgattcaccagtttaattacaaccaaagttcaagtgtattatgtgtaacagcttttaacgctgttcagtaaaagcgagctgagatttattctggtgataaagctgaacaagtacagggttgccaatggctctttaagagctaagtgtccttgagaaatgtttctttcttggtgtgaccgtttcagtttctgggtggagctggtcatagcttctttgctataatttgtgtgagcgatgttgctggtaagttgccatggttacttgaacccactgggcagcaggacagattttcattataacgaatgtgaacacgactagaagccgtgggtgctagtctccggaggagccacctcccttgttagctcatgcagtcagcccctgcccagtgtacatgagcaagagaaacatctagtttggttctctctgctcatcttagggaagaaaccatgactaatatggggggaaaagggacaaatagattgttgctagaaatgtgcttcttgatcatacttgtgcataactactcttctgagatagtaatgataaatgctttctaagcaatttggattcagtttaatatagttatccagagcccaatatgttatccagttgaggagaactgccaggcaatgaaatgaaaattaagatacttattaccatagtcacatttaggtttgggtgtgtaaaagtagctgtgattgctgatatggaatttgcaataaatgagcctctctctctctttttttttttttttttgagatggagtcttgctctgttgcccaggctggggtgcagtggcgcaatctcggctcactgcaagttctgcctcccgggttcatgccattctcctgcctcagcctcccgagtagctgggactacaggcgcccgccaccatgcccggttaattttttgtatttttagtagagatggggttttaaatgagtctcttaaggaggcatcacagcctggtgggaaactagcacaagtgtggtaggctttggagacagcggggcttgggctcaagtcctgattctgtattcaccaagctgtacacagttgtgtgcctcagggcaaatggttcagtctctctaagcctcaatttatttatctcgttatttatttatttattaaatttttgtgggtatataataggtgtgtatatgtatggggtacatgagatgttttgatacaggcatgcaatgtgaaataagtacatcatggagaatggggtatccatcccctcgagcatttatcctttgagttgcaaacaatccaattgcactctgtattttaaaatgtacgattcagttagtattgactatagtcatcctgtcgtggtatcaaattgtgggtcttttttactctttctatttttttacccattaatttattcatctctttatgataagaataccaattttacagggaataaataaggattacagaaaatgaacataaatgccctgagaaataatagacattcaatgcatggtggttagcttgtttattttttagattttttttagcttaaaaataaattggaatgaagaaatcctcatggttctttgtatagcgtttgtctaatattcattaaatagcttagttttttcaagtgttgttatctggtgtaagtcgactatattcaaattaaaaaaacctttggctttgaacagttttgttttcgtatcaaagcaacaaaagtcataaataagtccatttgtacatttcaacttgaaacgcttggagttttatacagttatacccacatcagagagcctttccctaattactggaatacaacagctagttggagggagaaaaggcagtgtcactatttggaccaagatttagaaatattttttctatttaggtttttagaggaagtttaaagcaaatgcactttctaaattggattatacttggaataagtgccttctgagaggttgcaaatgtcatcttttttcctgcctccctggaaatacctttagctgttgagagcacttgaagtttgggggactctggtacaaaatcccaatccatttacctttgcttgaaggcttgtttagtaatttccccctaaaatctcgtaaggaaaatgccctgggggaatgggagacacacacagccctgccatctccctgcacacaaagggcttgtagctccatcagcagcatctgcacagctgaaggaagcaaatgttcttgaggaagatgagctgcatggtggctggacaaagggaagccaaagagcaggtatttggcagttttcccagcactgcctgagagagagagacagacagacagataggaacacctacagacaggcactgtctctgcatataggtgttttccagtcaaatagttcattattctttttcgtgatctagaactgtagctatcaagtggagaagagtgtgctttagtccctctgcaacatttggcaatgtctggagacatttttgttcatcacaactggggaagtattaatggcatctagtgggtggaggccggggatgccactgtacaacctctgattcatgggaaggccgtgccacaaagaatgatttagcccaaaatgtcggtagtgacaaggcttagaaaccttggtcacttggtctagagaaaaagcaccccttcaggctgtcctatgtccttttctctgatcccctctactcagaatatcaccttctgatggcttgtatggcagtttacacagcttgagtcaaaaacaagatgtcctagctggtggccgataagtttatagcctctactggaaataaaccggcaatcttgctgattcacaggtctcttacaattcaagtcaattctcagtgtggccagttttggatccctgaaaaaaatgtagtaggaataatcataagtagatacaattattaggcccactttgcagaacagaaaacagagaggttatgtcccagccagcaagagagagggggagtccccaaattctttcccctttcctcctggacacacagcttaacaacatttcctactttgtccttggcatttgggtgtcctaaatgattgagatctgagcaatgaaatgtgggcagagtggtgaattcctagtccaagcgaggcccattaactgtgctgatggccttttattctctctccccgctggcatccaaatagacagggctttgaggacttggggaatggcggagccacagactgggagaagccttggttcttgacttcctgcttggaggagcctgaccagaaagcttcgccttattagagtgttgcatgagcaagtagtaaacttagattgtgttaagccactaaaatgttgaggtaagtgtgaaagaagttagccttctctgactaataaaacaatgaaatagacaagtgtacacatgaggtgacatggcttgtggctagctgactgggattatgtgaagaaattcactttgatcaaatttgagcaaaggtacgaagaaatttacaaaattgatgatgctctgaaaatgctgctgtttttatttgtatgtactctcttctgaatcatgtttaagaatcagagtatacattaaatccctttatcagtattttacatgatggaggaaaggttatttatctcacaggcagccattttagtgatttcgggttcctaaaccatgcatgaagagtcattaattcacatattatctcctaaaagctaagtgttgcatgtgagtctgggacttagctgagaaatgtgtaatacacagggtttttttttttgccagaccattcccagttggttgcacatctcaggagccaaagcttattactttccaaatggtaatttaaacttgttaaattacctccagacctgtcttttttgtgtagcacaatgggaaaaactcagtgccttggctccaaatgcatttttaagaattcctctttctccaaaagcctacctcctttgggactgcagcatcattatttcataggaaatttgggcaggagcatcttttaatgaaaacttttttgtttttgtgtttttaaagaggcatttactgttgcatctggcaagtggtgtggctctttctgggagtgttgcaaactcgtgatgtagtcacattttaggatctttgcgggatggcttcaaggagaaattaggctgtataactatgcagagaattgacctggtaaacacattagaggtggattatcctctattgctctctaagtagcacctgaggaatgtacaatccatagctattccagaacctaagcaggaactttgttgccgagaaacagaagcttcatatttgctcaacatgctcaattttcttcaatggagaaagccttctgtggtacaccagctgcctgcatgaaggctaggctcccacaagcatgcattgcacgtgggaaaatgtgcatgaagtgttcatatcaagtatgaaaaacatgcaatgttccatattaaaaactttaaggaatgggaagattttcagcaaaaccgtgtatcctcatcttttattttatttgtatgaatgtgaaactccaatgaatgtactaggacacaggaggacaaggagggaggaagacatttatgtacttcagtgtagtaaactctgtaatctgaacagttttttcttgatgtttttgtcatgttccaagcagcagattctgcaacatggtctgaccaaattggatttgggttgttagttgcgtcaataattaatagagaagaacttttaagtatgttgaggaagaacaggactgaaaataaaagcaggttttttttttttttggctacttgaattagttaggtggaatgttatgctgcagtaacaaacatccccaaatgtctgtaaccaaaaacaataaaggtttatttcttactcataccacatactcattgctggagggctctgattcatgtcatttctactctgagacccaagctgatgaagcctcttccatttagaatgtcatagaattcagtaacagtggggaaaaccatggaggcccacacatggattcttcaacactatagcaaaaatgagacacacatcatttttgctcagttttattggccagagcaagtcttgcagcgaaagctaacttgaaagagtaaagtctgatcatcctgatacctggaataggacctcgatattggtaaatagtcatacacatttcattgttgcataccaacagacacacactcacacacgtatagacatttagccttaagttcaaatatgaaattgaccagaggaaaataaagacatctaattcgggacagttttagaattgtagctcagaatagggagatacacagtgaataagattcttttgctggttaaggacttgttagtcaacaggtagtagaaatgcattcaggggtcacttgtccacccagactctgttacaaactagcacaatataatttgaactgagaatatttaatttagtcttctcattaaaaaataaattgaatagagttcagactaaattttgacttaaagttttttttttctttttgaacagcaggtcaaatatcagtgagaaatatgtccaaggatgtgaaacattgttactgaatcccattttcaaggtctgttgagtagaataaaggcaaatatgaagtgtgagaaaaagactttaatttgtgattagggagaactgagggtggtactatctgattttattgccacagatataatctcagttctttcttgtttataactgtttacaacattaagataacctcttagtgttattttcattttctctttcctctaactttttttttagttttctttacccaaaatagggaaaatgccagttgccttggagaagttggaagagacaacacagcaataaaatggagttatcccaggttgtgggaaggcaggacagatggataaagtatgatgaggaaaagagattggctaatatccatctaatgcagctaccaacaaaaacaaaacccctaacttcccttttgaaactccttgttaggtcaaaaagaaaataataaaattaactcagcatgatgcctgaagagtaaacatttcattctactttgtttttgcctcaggttttaatttatcaaacacatacagagaaggtctctcgtgctgccttccagtctcgccatattttaacatatagcagaacctaacagtgctctgacctgccaagacagccttccctaaagcaggttcattacccagcattagcctactttgtgcactaaaatattgaagaaaatatttgcaaataatgtagctaataaggaacttgtatccagaatatataaggaaatcttacaactgaataataaaaaaagaaccaactaataaatgtgcaaatgatttaaaaagacattttgcccaagaacatatacaaagggtcaataagcatatgaaaagatgatgaacatctttagccattagggagatgcaaatcaaaactaccatgaggtactcctttatacccacttgaatgaaaaagacagataataacaagtgttggtgaggatgtgtagaaagtgaaacccccaaacactgctggtgggaaggtaaaatggtattggcattttggaaaacaccgtggtaattccttaaatagttaaactggagttaccgtatcacccagcaatccactcctaggagtacatatccaagacaaatgaagacatatgcctgtgcaaaaacatgcacaaatgttcatagtaacattattcataatagccagaaagtacaaagaactcaaatatctatcaactgataaatagatgaacaaaatgcagtatgtccataaaatagtctattatttggcaatacaaagaaatgaagcgtggatccaggtcacaacatagatgaaccttgaaaacatcatgctaagtgaatgaagctagtcacaaatgaccacatattatatgattccatttacctgaagtatccctgaataggtaaatctgtagagacaggtagattagtggttgccttaggctggagtggggcctggtggtaggatggagttgctgctaatagataacgagtttttttttggagtgatagaaatattttaaaattagattgtggtgatgatcacgcaactctggaagtaaactaaaagcaattgaattgtatattctaaataagtgaattttatattatatgaattttatttcaataaagctattttgttaaaaacaaaaaacagtaaggtagatttcactcagctccagtaccgaaacataatgccgcctgggagggtttgctagctcagtagtttataatgctgtacagcgggttccagtatctgtccaaggaatgaatgacagctctttactgttccaatgatcaacttttggaggcctttccctgcctccattccacaccacctacactgagatgcctcatttcttgcttcttgcttcagggcatagggttggctaaaagttcatgatattttctaataaacttgtttgaaatgctgtatgaaagtcctcaatcctgatatccactaatgacgatagtaggcctgcttcccttcagtgtgttccacaaatgctggctacctgcttgaacaatgtaaatgactggctgtgtgatgctggaaccacctagagctttatcaaatctgcctgccttggtgtggtcttggtctcactgtagggggacacacacttgcagggtcaggcgctgtgtccctggggaaaagctgtaaaaccccagggttttacagggaagagaaatgtcctgtttgggattccaggggcaaatcattcagctattcctgggttcccttatcctctctatgcaatgcccctggacttttccctaccagagccccacggggatatgcctgctaaggccgttaagccaaatattgtatggactatatttagttaaacattttaggcacataatacatttttgttgaatctattgttaatggtgtaaaaaccatctttctgccactttttacaaaagagacctgaactactgtacattataaaacctttttcattaactttttagtagagaaactcttcgcctcaaccaggattttctgtaaactataagaaaagctattactaattctcttaagatgtttatgaaaaatttatttttagtaaaagtgacagtccagatattttcatagctcattctctaactttattcaggcctcttctagaatgagacttttttcgcagacttcttctctgatcaccctgtcaaaagccacagggtccctattactcccaatctctttgctctcctttgattttctttatagccataatcactctctgttttctattgtattatttctttattgtttatctccctcatggaatgtaaactttattagaaaaggaccatgtcagtcttattcactgttctgtccctagacctcgatcaagtgtatgacttcttgtaggtactactcaataaatatttattgaatgaataaacaaatacctcccccctccatacacatactcctctctccaaagtataatttgagaggagagcccgacagaatacatagcaaatgaataagcccattttccaatagtagttagtcattacccagcttctaaaaacctagggtcatgcagaaaaaagtggagagaatgtaggagtttgtaagagcactcttatccaactcccttttctgattaggagactgaggtcccaagtcacgaagggacttactcatggtcagaacaaaattgagtgacagagcaaagactatagcttggatgaagtgcttcctaggcacatggttcccattgtcagaatgtgtagaacaaaagttttattgcaaggtttagcccttgcaatgaatttagtatgcatgaggattatatcataattataagccagatataaactagggagtgttgcttctttgaggttcaaaaattactgtctgagaccccatctcccatgtggtactcccaccagagatgaatgtgcaggtgtatggacaggtggctctatattctatgtgtttctcagggttctccagagaaacagaaccaataggacttataaccaatacaatatatcattgtgttagtccattttgtgttgctgtaacataataccagagactggttagtttataaataagaggtttatttagctcacagttcttcatgctgggaagttcaatgcgcatgatgctgacacctgtttggcttctggtgaaggcttttgtgtagcatcatatggtgggaggtcaaaggaggagtagacccatgcaaagagggacaggaggaggaaccttgctttataacaactgcctctcctgggaaccaacctgttactgtgagaagtaatctagtctcacaggggcaagaactcattcatcacctcgagaatggaacaaagccaatcctgagggatctacccccatgactcaaacatctcccactaggcccacaccccagtacctccatgttggggaccaaatttcaacatgagttttggtggggacaaatgatatccaaaccatgacaatgattaatctcattgggtgtatacattatacatatatattgtatatatctatatataatatagatattatatatatacacagttgacccttgaacagcatgggtttgaacattgtgagtctagttgtatttggaatgtcttccacctctaccaacccctaagacagcaagaccaacccctcctcttcttcctctgcctcagcctgctcagaatgaagtcaatgaggatgagaacctttatgttggcacactttgacttaatgaatggtaaatgtattttctcttccttatgattttttaatagcatttctttcctttagcctattttattgcaagaatatagaatgaaatacgtatacaaaatatgtattaatcaactttttatgttattggtaaggcttctggtcaatagcaggctattagtagttaagttttgggggaatcaaaagttatatgtggatttttgactgcatgggggcttgccattcctaacatctgtgttgttcaagagtcagctgttgtataggcaataccttgtaagaaatatctttctagaaaaaaaatttattataagatgttggctcacatgattatggaggctaagtcccacggtctgctgtctgtgacctgtagaaccagaagagttggtggtgtagtttgtaggtctgggagccagagacgtgatggtattaaggccagtccgagtctgaagactttagaaccaggagcatcacaggcaggagaatatagatgtcccggctcaagcactaaggcagagggagtgggaatccaaccttcctctgcatttttcttgcttttaggccctcaacagattacgtgaggcctgactacattgaggagggtcatctactttactcagtccacaattcaaatgataatgtcttccagaaataacttcacacacatccccagaaacaaacgtttgatcaggtatttggtcagcctgctgcttagtcaacttgacacataaaattaaccatcatatcctgcttcttccaagttagtgtaaggccattgattttttgtgtatatgctgtgcctttgacaccttgccttgttcccaagtagcctgtaaaggtattatgctaaaccaaaggagaaattatatcattcccttaagaggcaagagtgtcttccattactgatggctttaaataaagaacagatgacatgaggtaaagcatttgaattattttcacccactgactactattttaaggaaataacttttaagacatttaaactcttcaggcattgtccattgttactggagaaatgaagggtatggtagaaagtacacagacttcgatggggatcttggccttgatatgtacaaagtatataattttagacaaattaattgatttatttagtttcctgattgtaaaacagaaaagaatacagggtattaataaatgagataatacatgtgaaagtggtttgttctagactgctgcatgcaaataataccactattgtgtgagcacacatttttacagtagtttcatttctttagaaagtgactgcatgagttcctcaagctccctggccaatggcattctttagtagctgaaaccctgaaaatgatattctctctggagtgcaaaaggcagttcaggtacagacaacaaattatgtgtaataacttagaaggcaatttgaggaatagcctgccccagttggaatttttttgagcaggtacatttcaaacaattggctaaagacctgagttcagactcttactcttgagagatcgatttcttttcgtagttatactggtcaagatcttagttttttgttttgttttgttttgttttttttctcttgttcaaaaagacagcacttcattggcaaagatcctgcccttttaggcaggattgatatattttgctctctgaatgtattttacttaaagtcctttcatgtttagtactttcccccaagaacaatacatcagcattatttgagtagccagcaagcatgtctgtggcttttgactcttttctcatttgtgtgggatggatagcattttatctcccctattcatcattccctttgctcttacaaaactttgttgtgaagcatctcaagacacgggatcagcaggactgtctttttccttcatagaagaaagattaggatgtagcgctattaaatgactcacgtgtagtctcagagctggttagtggcagagccaggatgttttctttcctcataatactaagggcattgtcttggtattattctgtcatataggcacgtgaatagcagaaatgaagaatcctttgccaaccctagagaagaggagagtaatatacttatgcttctctaaaataaccttgcttagtagcaccaatcctgagtgtgggaacatttccaaataagctaccactttccatttcctgtcattattctgtgtctacatttggaggataaaaagagatggatggtttggatgtataatagaatgaaagcagaaaaataatgaacaaatcactttctttgtgatgcattcattcatttatcgatttactcctcaagtatttattgagtacttactatgtgctaggttctgttttagtcaccaaagatataggagtaaagaaaatcctaagtatcccagcctcatgaaccttccaatctattgagagagacagaaaggcaatgcatcataaatcacccagttactgtgattgcaatgaggataaatgattgaaagaaaaggacagggtaccatgagctcctacagtaggacatttcagctgagtgcagaagtctagggaagtctcctgaaaaaggactccttagctaagactaaaaacatgggtaggagtgtggcagatggtggaagcttggggacatgacaagcaggaagggtctaggtaaagagaagagtttgagcaaaaatcttgaggcagcaaggatcttgtcatgtttgagaaacagagatttgaagtgagagagcaagtggaagggcataaaggggataggaagaggagttgttggtgatctttggtcttggtcttagaagagctttggaaatcacacagactattttgacctctttcacacagcaatggaaaattattagaattatctttctaagcagacaggagcattatcggcctggctacagagaaaggaaggatggagaagggcaggactgtatgagagacccagtaggagatttttgcaataatccaggcaagcaataatgttgtctttgtctgggaaggtggctggtaggggatacaagcatggtacatcttatccagattgtgaaggtagatttgattagaggtaagactggagggagaggaagattttgatgataactccccagactggggcatgggagactggtggtatggcatgattccatactgatgatgagatcattagaacacatttttgtttgtttctttgttttgttgtttggagggttgtggtacaagagttatattttgggcatactaaccttggtatgtgagtcatcaaaatagagatgttgatcttggctgtattgatccggagctcagaatagagaactggactgaaatgatatgtatctgagctattcacatataaataacatataaaagcttgtgggaggacgaggtcaacagagaaaggacacatgagaagcgaagaggtcccaggagcagccccaaggaacagttgtttggcttcttaagatgtgcattacaggaggtcatcactgacaaagtttagggtggggacagcaaagttgaaggcagtgtttagagatatggaggagaaccttgcagaggaaactgaaaaaaagcaactggggtggaaggtgaaaagccagaagagtgtgatgttgtggaaggcaactgtattagtctgttctcatacaactaataaagacatacccaagactgggtaatttataaaggaaagaggtttaactgactcacagttctgcatggttggggaggcctcacagtcatggcagaagatgaaggaaaatctaaggcacttcttacatggcagtgggcaggagcgagcttgtgcagaggaactcccatttataaaaccatcagatctcatgagacttattcactaccatgagaacagcacgggaaagacccacccccatgattcagttacctcctgctgggtccctaccatgacacatgggaattatgggagctacaattccagatgagatttgggtggggacacagccaaaccatatcagcaacacaagatatgtgtggatgctgccgagtgcgtgggcaggatgaagtgccatgaggatcatgggtaacccaacctcaagctggatgaaacactaaagcataaagactcagcatccgattttgtcctaataactaaatggctcattactaagctttgtagaatttcttcttctgaatatttattaatttatttattttgagacagagtctcgctctgtcacccaggctggagtgcagtggtgcaatctcggctcactgcaagctccacctcccaggttcacgccattctcctgcctcagcctccagagtagctgggactacaggcacccaccaccatgcccagctaattttttttttgtatttttagtagagacggggttttaccgtgttagccaggatggtcgtctccatctcctgaactcgtgatctgcccacttcggcctcccaaagtgctgggatcttctgaatatttttaatgattaaaatgatttttaaaaatatttcacctggaagctagttgaaaatagaatgaaacccatgaagcaattaaaaaatgaactccactgactcacctctggattttggggcagtagaaaaccaatgtagtaacttgaagtcaatactgtttctgtattgccaagttcaaggccttaacaaattaaaatattgaaagtagcttttccagtctgagtagacaatgtggggcacacctggtgtgtcagtattgtaaattgatattcatgcagtttcctgattgacttttttgagtcttcaatatgaatggagtggagtctaaaaaatgagacttaggtgaaagattttagaaacacaggttaggaaataatactacttgagggattcaaaccatgtgtttcctctacttaaattctgctttaaaatgtgtagtttacagtaaatttttatggttagtgctatagaaccttcttcttcttcttttgtttttcttcattttttctttttcctttatttctttttctcttctcttctttttttttttttttctccagagtagctgggactataggtgcatgccaccatgtctgactaatttctaattttttgtagtgacagggtctggctgtgttgcccaggctggtctcaaactcttggctcaagcaatcctcctgccatggcctcccaaagtgttgggattacaagtctgagccacagtgcctggcccagagccttctttaattattatttaggtgttacacacctcaatgaggagtgtacctaaccttaaccctaaccctgaccctcagtgaggagtgtagctgcttgttttggttgattggttgagcttgtcacataaaagagcaaggtaagataggaaattgaattctacattggatatgaatttcaggtattctattattcttgcaaaaaattaagatgttatagactctgactttttcattgttcagtaataacatgtgaaaaacgatctggagaaaaacaacaaaattttataattcaagtgaaattaggtctatcattgactaagagtcaggatagttggcttttatagatccaataaaagtgtatggaaaatccattgtgcaaatttctagagcttcataagacacaggtctttgtttcagggagctcatagttgagtggaagaagacaagtgtatataaataattataaaacaaggaggtgttgatttttattacaaagatgtgttttagaaactcaagaggagggtagaatgttgtgggagaggatgcacagaggatataataaagtgaactgagtcacagtcaatgcgaatagtgaaggcttgtaggaggagggaagggtcatttggcatgcttagcatgaagttgcatctagtggaatagagggagatgaatttgtcaaggtagagagtaccccaattgtgaaggacctgcctgccaagctagggggctgttgagcaatttcaaatgattgacaggtacttcttgtattacagggcataatctctggcaaggtttaggatggggagtagggttagaggcaggggactggttaagataccattacagtggtccaggtgaagcacaggagaaaattaccagtaaaaagacagctgcacttcttaaatagaacagaagtatccctgaaaaaaatatagatctggattccaatttcaattttgtaactatattagagttcttcaaagaaacagaaccgactggatgtatgcatgtgttgtgttgtgtgtgtgtgtgtgtgtgtgtgtgtttgtgtggagagagagagagagaaagagagagagagagaaagagagagagagagagagagaaagagagagagatgctggcaagtccaaaatttacaaggtaggccagcaggctggagacccagggaagaggtaatgttgacgcattacttcttcttccagggacgtcagcctttttctattaaggccttcagctgcctgggtgagactgactcccattatggaaggtcatctgctttactgtaaatctactcatttaagtagaaatttcgctcatttagcatctgaaaaataccttcacagaaacatctagaataaagttggaccaactaactctctgggtatggtggcttggccaggttggcacataaaactaaccatcaccttccgtgttcttgttcagctgattgaggttctctgaggctaagaaccagaatttaaacatgggagccagaggacctgggtttgaatctcagcccattattaccctcaggttattgcatcaattagttagcctcactgtgcctcagtcttcccatctgtaaatatgtatacacacacacacacacacacacacacatatatgcatacacacatacacacatacacaaacaactaggccttaagtgacactgatggttatgtatttatatatatatatatatatgtatacacacacacatacatgtatatatatatacacacatatctatgtgtgtgtgtgtttgtgtgtgtatatatatgtatgtgtgtgtatatatatataaatatatatatataaatatatataaaaaatagtaggggctccagacattaaaagtaatttgcctaaggtcacctaggccttaagttactgtgatggttacatacaagttaaggagtattacttaatttattttaagattctaaaattttagatctacaaggtgcccttgacatctactccaacaaattcatatagtggatgaggagttcgcggtaacttgctccattcatacaaataggtaactatgctgttctctttcaggatgccatgctgtgcagtagatattttccccaaagtgcactaaatcaaatttccatagcttcaatcttgtttgaaacattctaggagacgttcctactttactctcacatagagtctgctgggaatttagatattagcatacgttactgaatttctgtgagatagatagagatagggccttggtatgagactcgcctatacagagagaagcttccaagccacaggcaaaatgaaaacattgttcatgactgttttctgagcagcactagcatctgtgagctgattttagggttttgtcattccccatcaggtgtagggttttcagagaaagacagtgactcatttttcttaaaaaaagttgtagaggccaggcatggtgtctcacacctgtaatcccagcactttaggaggccaaggcaggcggattgcctgagctcaggagtttgcgaccagcctgggaaacatggtgaaaccccgtgtctactaaaataaaaaaattagccaggcctggtggcaggcacctgtagtctcagctactcgggaggctgaggcaggagaatggcatgaacccgggaggcagaacttgcagtgagctgagattgcgccactgcactccagcctgggcgacagagcaagactctgtctcaaaaaataaataaataaataaataatattttagaaacacattaccccttctgtttaggaggtgcatttctagatgtgatgttcactaatacagctgagtacattgctaaggagcgtttaacgtttcagtggtgaactccaatgatggtgtaagttacttggcaaaacaatcatcaatggcattttcttcttagtagagaaactagaaaaaatagccaatagaatcaaaacttaaaaataattcttcctctctagaatgtggttttgtttagttttgttttgcatataaggaaataataataataatacaaagtttatgtggatcagtgtgaactgaaaactttgcatgattgaaatcgttttaacatcgaaataatggataaaaagttcttaacaaggccagtggacattcttgaattagccatcacatgctatccaataattggagcgatgtgctaatttactgtcgtgcagctctgaagattttatgacattcagacacttatcttttccctcaatcacagcaattcagacaggatattcatctttgaagctttagccagcctttctcttttcgtgctaaaccctctagaatgttatctctggcattttgagataatttttgaaaggttattttcaaattgccttcattcctattttgatgtcatttaacttatcacatgatgagaacattaggctcactgctgccttggaaagattgttttaaatccactttacttcgctatcagtatattctttattaaaaggcttaaaagtatttaaaataagtccattaccatttttagggtctcattttggaattgtttttattgtttcaggggcactgaatattcaatttgtatagaaaaaaagacaagtaaaagtattcattttctattacttaagttgggataaagggagtcaaaagtgatcctgtttgaattccttggccttaatcccatatctttcccccatcactttgtgttttctagaaggcagatttcaaataaatataaaatatcttaattgtagatttttgcgtcagaacaatattactatatgtttctatgacttaattcttgagacagtgaaaactccagtctaatcgatgtaatagttataatgtagatgtacaggacattcctcagtacttttatttggaacttctttcctgcctcactcctacctgggtcaatatccagacaggatgcctctgcccctgcctgtggcatcgctgctcctttgccatccctccatgccttgggctctgtattagtccattctcactgctaataaagacatactcgagactgggtaatttataaagaaaaagaggtttaatggactcacagttccatgtggctggggaggcctcataatcatggtggaaggcaaaaggcaagtcttccatggcagcagataagggagagaatgagaatcaagtgaaaggggaaaccccttataaaagcatcagatctcatgagacttattcactaccatgggaacagtatggggaaaccgtccccatgattcaattatctcccatcaggtctctcccacaacacatgggaattatgggagctacaatccaagatgagattcgagtggggacatagccaaaccatatgagcctccctcctatctgccctacgtgagtgagcagggaggagagcacaggacgtgcagaagaggaagatgtgtcatggcactgactatgcatccttcctgtcctatgggtaccaccaacatcccagccaaggactggacaataactgcattgtgacaggctagagataacattctagatattatcatatatagcatataataattactatattatctaaccattttcatcaagatttttagagttcctctttcacccatacagttaatgattccctgttgccatctctgatatcaaactaaggtttggcagcactttgatgaccgatgttacagcattttcagcatgcaatctcggcccccataagaatgtcctccctggtgctatattctgtgaactgccccttggctgtacctcccattcctagagaacctcttctcctcttccctcacctgatcttgcctcccctcagatacagacacttcctgttaattaggactcttgtcttggaactactgcttaggtaggatgactcttgtcctcatctatcccattttggggtcctcttagcttgtcttcccagtggtggtgggctttcatcacttccacagctaactctgagtcctgattcaccccacagccaggaaggcgcttggacatccatggcacatatcataggaaaaggaacaaggaacaaggattaaatcacgtaaaacctagaggtcttgttaacacgcttgtcaggctttcacatcagcataagagtactactaggttacagcgtctttaggtctgaagttgtcttgtagggtgggagtccaggcatctgcccagcagaggaggcagcagtcttaaagctcctttcagcagacagaaacaggtagagtgactcctccaattactgagtaactaattggagtcctctttaatatgttctgcatgataaggtggaatatcttaaaaacagctttggtatttaaagggaaaaaactgtggtttgttatatgggatagctgcagtgattgaatctgctcttcactgatgctctgcagccctggctacacaatatatgcagctgctatttattctccagacatggatctgttgggttcatacattttttcatacattccaggtgttacatcgatttcttttggatgcatgcattctaattaaaaacataaaatatgattatgtcaaataattgtaacaaaagtagacaatatctcagtttcctgtttatgagcattgctctactggccctcccttagtagcagtggtgattttgggggttatattgacagaggtcttaagtcatccatctcctctggcctgatgccttctgtgatggggagcatgcatttgcaaaacagtgggtgggaggtaatcatgcagtttgtacctgtggactggcccatgtgggattccgcaccacagccaacaatgaattaacatgccgactagcgtgtgactgacatacacaggtttttctgctcccctaattgcctagaacatttcatgctttttttttgactccttgccatgaacacagaaatacactatattagaactcgggggtttctgcagcccgaagagcttgaaatcacccgtaacccaaaaggctcttaatattctatattgaagaagattcaaagaatctccccaaataggtgattcggctaccaaattaccaaggtgatcttcatgagggtttttcagcagaaaatgtctttaaggatttaatctactctgtgcatttttagctatgtaatcacctaaaagtctcgatattagtgagcttcctctcgtatttcatttctagagctttgattgcactgaattaaccatgtgatatgacccaaatatctcctctgatctgtaccttgtcatcataaaatctaattcatagaatgcattttgccttttagaagtatcccaatttttgctgatatcatacagagagtactcaggtactcacagcctcattactctattattgagcctggcttatgagagacttcagagaatttaggcacttttttttattcttctcagcagcagtagcagaagatgagctgcccatcactcagacgactgtgtccaggctccttagacaacagggatctccccataggctggcctctccctgcttccttgccatccctctctgactcctacttcatattccgtagttgctagagtcccagattctttcacacctctgtgcctttacttgtgttgttccttctgcctagactgtctttttctaccttctttgaaacattcctataatgcattctttatgactttgcatagacaccatatccttcaggaattgctctctgatcctcccaggtagggctggcagactctatgtaatcccagggacaccctgtagaatatctcttgcctccccttgctgagataagccatgtccctctctcctctgctttgtgcagtgctgggtcactgtttgctcccccatgcattggtgtcatctgtcactcagtgctctatgctcaaagtagtagttacagggtgcgtagtgatcactagctgagctctactggaaacactggactctcctaataaactaataaactgagttaaaaaatacattaaagccacagctgaaaaagataatttttaaaaaggattgcttctgatctcttggatttctgggactaactcttacataggagtctaacccagttagcaaatagtgtattcaataaatggagtgaaacacataaatgttctttttaatttttttctttcttttcttttcttgttttaaatttcaagaccatgtacagtttttgtcaaggtcaagagagctgagaaggctaaataatttgatgtcggtgtgtatgtgtgttgcacggatttctggtcattcttgttttaagatggcaaaattccacagcctttgaaacagttgtctcgtaaatgctttagatgagagcttctcaagctttaatgtgccacccaaatacctgggactcttgtcaaaatgcagattctggatctgtagctctggcaagggccctgcattttctaacaagcttccaggggatgccaatgctgccgttccatagaacacatttagagtagagacgcgtttgtatgctgagggtgtctcactattttcagtgggtaagactttaaagccaaattattttctcctgtttcaaaatgctcaaatataaaagcaccgtcgacaacttgattataagaaacccaagtaaaactcatattgttgtctgtctaggcttttgaaggacctttttgtagtctaggcaagtttatgtgacataaacaagacgtgctgcatcctgatgaatttcagcttttttctttttttttttttttttggtgatatatttagagtgaaaggagacacatctcactgttctctttaagaaaattctactgagaggagctggcaattttgtggcgtttcccaaaccatttcattgtctcctattcccattgagtgaagagtagaatatccttgtacctggagattaagaagtctttcccactggttccccaaaacccctgtgcattagtttcttagggctactgcagcaaagtagcacagacttggtggcttaaaacaacaggaacttattctctccattctggaagccagatgctgaaatcaaggtgacagcagggtcacgtggccattttccccaagaaggctctatgggggacctcttctttgcctcttccagcttctggtggcttctggcatttcttgggtcatggaagtatgactctaatctctacctccatccccataggtccttcctctccatgtgtttgtgtgtctcaaatctctctctcctgtctcttataaggaaacagtcactggacttagaagccaccctaaatccaggatgaccttatctgtagatccttaactcagttacatctgcaaagaccctgtttccaaataaaatcatgtttgcaggtactgggggatagcaattagacatatctttttggtggacatcatgcaatccactgcatcctagttccttgaatccataatggatccagaatatcaagactggtgtctgagtctgtttgagctcctataacaaaatacaatgattgggtagcttgtaaacaacagaaatgcatttcttatggaaatttatttctagactgggaagtctaagattaaggtaccagcagatttaatgtctgataaaggattgctgtctgcttcatagatggcgccttctatgtgtcctcacatggtggagggggtgagcaagttccctcaagcttcttttgtgagggcactaatcccatttataagggtcccactctcatgacctaattgtctcctaaagaccctatctatcaatactattcattggggattagatttcaacctatgaatttgggagagataaaaacattcagaccacaattgctgcaaaagaataattcatgcaaataccctgttctttgcagagcacagtaagagatgctttgtccctgagtttcaagggagggattaggaaggtgtctatgccatagtctctgctctcaaagtggtaatcatgataactagagaagaaataatgaatagttactggatttttatgagtgatagtctgtaaaagggctttcttgaaagtttttgtttaatctttccaaatatgagataacctgttattgaatgatattacagacttattccttcatttataatatattttctttagataattggcctctgtttatttctttctttcttcttcttttcccttttttttttttgacggaatctcgctctgttgcccaggcttggaatgcagtggcgcaatctcagctcactgcaagctccacctcccgggttcactctattctcctgcctcagcctcccaagtagctgggactacaggcacgcgccaccacatctggctaattttttgtatttttagtagagatggggtttcaccgtgttagccaggatggtctcgatctcctgacctcatgatgtgcctgcctcagcctcccaaagtgctgggattacaggcgtgagccactgtgcccagccatgttcttggaagtaatattgattggggcaaatgccaattccagctgtttactggacttccctgggtctcagtttcctcatctgtaactgggatagtagtctttcatgaggactgatatgaaatgatgcacatagagcccttagctcagggtctgacctttctctcaagcattctgctaggtactgtacacatgagagttcagggcgacttgggaactgacagtactcagcaggtgaagccactggtggcacttgaacaattgtaagggctgtcaagttcacactccttgcccctagccccacccatttacaaagaactttaaaaaattgcatatctcagatcccaggatcaaattcattttcaaatggactgtttccttctctcttgaggggagagattgggtttagccttgctgaattggttattcagcttttagctgcctgcagcagaaggaaactcactgtcggtgattgaatctcccctggggaggatgggccgcttcctttccacatggcgctggtctgagtgaagtgggaccagatcagattagagaccaggataaaggaagtgcccccaatctccctggctcatggaaattccttcctattattctgaaatggagataaattatgtgataacatgttacaacgtggtgatccctcttgcgtaaggatgtttcaaaagtctattggccaataataatgataaaaaatctttgtttcacagaatgcacttgctacataaacattcagcaggttaactgacgcaccacaaattctgtttgctgcttgggaattttgtcagagcagtgcgtttgtctctgggaacatttgtgtctgtgtctgtctgtatttttctaggtgaagaaattcaggcctataaagagttgggaacttgcctaaaacctatgttgtttatagctagcaatgtggcttgcctccttatgtgccaggtgggatgtgaaatgcttcacatgggttatttcttttcattccatccttataagtcaggcactaatattgcacctatttcataggtaagaaagtcagcccagagaggcagaagttcagaagcgatagagtcacttctcccaggttccatgtctgggaatccatacagataatgtaagaaactgagagtctcagcagggcatttctgaatgagcactgcctaagttgggattatgtaagttggaagcttattgtggtaattaacaagttactatgggttaaggcaacagaagagacggcaaaagataatgtatgattaattcctaatgagtgaaacagccaatactcactatatgtgctcaaactaataggagtacacatttgtatttttaaaaattagataaaacatatagttggttattcaaaatcagcttaacatccctctataattttctaccacaaagtcaattcttaatctgttttcaattgcattgttcaatatgctgttcatagtaaacatttcctgaaaacattgacatttacagtgtggctttgtcaggctaattcatacttaccccacaaagacatgtgctgtggtggttcaagggcaatttaggtgaaaggttgtctgtagcacaggctgaaccagataagccaatgacatggcaggccatgtgaatttccttgcttcgcttgttataaaccgagaccgacttgagaaattagatagctgcctctagaaactcaggctcttgtaaaaaaataaacaaataagtaaaccagctaaggtagaattacttgtacactgagatcaaaagcctaaaagcctaataagaaacatcaacctatggtcctaaaagcctaataagaagcatcttgttttctttgatgatccaaacatgggcagtggagagacggctggcagaatcaccaatcttggagaattcctgggtttgtgaaatccagcataggctgggtgtggtggctcacgactgtaatcccaacactttgggaggccaaggtgggtggatcacgaggtcaggagttcaagaccagcctggccaagatggtgaaagccagtctctactaaaaatacaaaacaattagccgggcatggtggcgggcacctgtaatcccagctattcgggaggctgaggcagagaattgctggaacctgggaggtggaggttgcagtgagccaagatcacaccgctgcactccagcctgggtgacagagcgagactctgtctcaaaaaaaaaaaaaaaaaaaaaaaattccagcatataagtctaggcagtctaggctaatttccataaccagtgaccttgaaacttccatggcttaacacagttgagtctttatttcttgcacacagtgaagtccagtagggctgtcagtgagagggctctttgctagggttcagggtttcagctcttgccatctggtcacttcatccaacatgccttggggcttgtcttcctcccctggatcctcagcatctggtagacaaaggaagagagtatggaccatgtgtctgtgcgaaatgtgactcacatcagcccttcccttgtcccattgacaagtgccagtcacatgaccctaccttgctgcaggtactggggactgtcatctagcaggctgtccaggcctaagtgggggactctgatgttggtgggcacccgaagtttctcccacacctaaagactttttaaaaaatagaaatatggccatcttatgattatcatccctgattcaaaaagaggaacctttgcccggaagaggttaagctctgttaatatttgatatctgatgagcaagccttattctccctgcctgtaagatctgaaatttgaatcccagggtaacctcctcttcgtcaacttccttggtcctgagagattgaataaagttgctgctaagattgggagggactttgaggctttagtacctgaaagacagcatcttctccaaaccctcatggaggctgtcctgggtgatgagccgcatggcaggtggaaatcagctttgctgggcttggatccttccagggcactctgtgactggctctgcccactctgggcatcagttttgactcactctaattgtcaggtagaggcccctcaggacagttgccatctataacaggacctagagggttctattaagatgacagagggatttgatgagaatgagccctcactctgtgataagaacaacaaacatctccctgccaagttataggcagcaccagaaacgatgcagaccagcttctggtgtcagtcttccatttctcttccctaaggaaaagctgcaagctctgagctagtttggagaggaaccgtctctgcttaagtctcgctttcctccttttacctgtgggcccacatggttcttcctcttgatcagcttctctcttcagaattctaactagtgagtcttctattaacaatagcttcttcttgctgctgtaataaatgaccacaaacataatggcttagaacagtgcaaatttgtttactttttttttttatttgtgatgagtctttaaatgtattttttttaacttgttatagaacagttctatatagtgttctacatagtgttatggaaaacacaagcttgttctcacacatttatgcaggtgagaagtttaggatgggtctctgtgaactgaagtccaggtgttagcttagcgatcttcctttctggaggacgtaggggagaatctgtgtccttgccttgcctggccccctgcttcccttggtgtgtggcccattctccatcttcaaagccagcagtggccaaatgtttctcatgctgcaacactctgacactgactattctcccttcctctctacatttaagggccttgatgattacattagacccacctagacaatccaggctaatcttattttaaggtcagatgattagcaattttaattctatctcctatgttaacttccctgtaacatgtaatataacattagtaggttgtgaagaataggatatggacatcttttggaggctcttaatctgcccaccataggctctgcaaatgcccgagtttgagactaagggaaggcaattgaagctggtgatctgaaggtcaaggtctttggtatcagattgcctgagattttttgctttaatagtttctcatctttgtgaccttgggcaaactctttagcttctctgcacttccatttcttgccttgtaaaatgggtgtgataataggactggcctcctaaagtctttgcaaatttaaatgaggtaatacacgcaaacattttgcatagcatttggcccatagttagagtgaatatactggctgttagtaattagcaagttcctgttgttgatcactcaaggcatggcagtgtgctgtgcagctcagtttctgcacatgcctacactggcttttgcattctctggatgaggcagagtggtttttcaaggttgcttacaagaaagtataaaaacccaagagctaatgcatgctgggattaatacctaggtgatgggttgataagtgcagcaaaccaccatggcacacgtttacctatgtaacaaacctgcacatcctacacatgtaccctggtacttaaaaagattaaaaaaaaaatccatttggaaatgaaaattctctctaattgcatttgccactctgtcctgacactggatattgatgctttctcccctcatgggaatcttgtgttcacaccgtggtgagatcctttctccatcctccccaagtttccattgtagggaggagggccctagttagtcaatttcaccaactgcctggatggtgcaaaacacacactgtctcttgggtaacagactacttgaagatgtattcagtaggaacacagtagttttatttgctgagaagtgtggatagttcagtgggttttttaagagacaaagggctgactagtcgccagaccttatgctgtgatgtcagatttccctgagcatctggcttgtccaggtgtaggtaagagcaggaaagggttttctacttggaaccttctgtttctgatcattgtttgcagaggggccctgactttgtttcaacttgatacatctccatcaccaaagcaggcctgggatggattttatctgagcacaagggattttagtgaaccaaaccatctggggagtcaagggaccttggatctgcatccttatgggtgggcatagagggtgaattatctatattctattgaagtagttgacagaagaccagggaatctggtctacatgtattaaatttttgcctgtgcaacggaagcaagaaggcaatgatgctttgcatatatatattttttaatgtaagtttcaccattgttctaggtaagaagcccagtttttatcttctgggagaaaatgaactagatcattagggagtcataatttcctttgtagtttttctaatagtttcattgaaatgttgtttgatgtgataaaaagaacctatttttaattttaaattagcatagggaattaaaatgttaatgtatataatcttactataaattattacaatcctattactaaataaaactgagtttggagtatgaaataaatataaaggtgtcttagtcactttggactgctatgacaaattccatagatggagcggcttaaacaatagaaatttgtgtctcacagttctgaaagctggaagtccaagatcaaggtgctggcaggtccagtgtctggtaaggggcctctttttagttggtagatggctagcttcttgtatcctcatgttggaggtcagagaaggaggaggcaagctctctggtgtgtcttcttataagggcacttgtcccccatcatgagggttccaccttcataacctaattccctccccttgaccccatctcctaacagtgtcatattggagattaggctttgacgtatgaattttggagggacacaaacattcagtgtgtagcaaaaggtatgatgttccaattatacaatgtaaaaataaaaacttctataaaggggaaaggggatgattatattctttcaaaagtgagtgaaatcaatgaggttttcctccaatcactttctacttctttccagttgattcttttaggcagtgaaatcatttcttgaccaagagataggtcttctagggagaaaatcctaattttcaagcactggtcacatggtgtacctcttagtgccacttcctcttgggctgaatttcaattcactgttggagcatcacattcagaatgccattctaacatgggacttacatgtgacatgaatgtgtttaccccaagttctaatcaaataaactctcccgcttctctcaatgttttatgcatctttatgcatgttcaattagaaattcatggaaacctgtgcagtaagctaagctgttggtgccctgccttctggtactgagtttcctgcctcaaaatggtctgtgtcaaagccagggggtgcaaatttgcctatgtaaagtggttgatgaaaattacatctgctgcctaatatgtgggaaagtagagcataaaatcagagtgtgttgtattatttttactttcctcaatcccttacttgcctttcaattaaaattaaatttttctactgtttgaaacacgtatttttaaaaagttcttaccttgtttctaactccctgattgtacagcacaagatttggggttcaggggcatgttggtctttgaaaaatcctgtcagtggttgaaagacacaaaaattgttgggaaagagttctggttcttgtaagttcccaggcctaaaccaacttccccagtgcagcctcagtgcacttggccaggcgtgatcctctgactgtttgctctggcaaaaggaagagaaaatcttcaccgtctctttagtattagagaagcgtggtagagaagaaagccaaaaaatgatgatggagattcagtaggggaaaaggaataaagacaactggaaaaaaagcacgaacgtggcgagagcagattgctctgagctgccaaagcaaataatccattaactcctcacttgctctgaacatgaaatctgtggtgcaaatagctagcgggagagttgctgtctcagaaagaatggaggagcagagctttggaaagcctgcttgaacctggtctcagaaagaagaataatcatgcaatcgaggagtagacaatgggttgagaaaggaacagcactctcacatattaaatatttcttgggatgaaatgttatcctaatttcttcccccccagccccaggaaagagcagctactattttttaaacataaagactatgtttcttctgagagatatagaaaattacgggcacacgatgggcactttacaagtggaaactacttaagaatatttaatgtgctttagatatgtgtcaattggacaaagcagcttcatttcaaggctctgagaagtcctgtcataaagaaactgtttcccattagaacatttgctaaattcctgacaccataatattcctttcccctccttttatcttttgctttgtacatcgtgctgatgggtgaaacaaacttaaaaggaatgcttgtctatctccctcattttacaaataaggacatgagccaaaagaaaagataattgtccaagcttcttttctctggaaggactgaactgaaattggaacgtcagtgttttgcacagagcgcacctgttagctgttgtcctctaagactgataaaagtcctactgcagcaggagcactctttgaatgctctatggcataggctcatgattcaatgggcctctgaatgttggttttgcactgaacaaaacttttgttggacctaaagctcatgcctgtgttaagagacctaagaaattctagaagtgtaacaagagtttgacctcccagaattcctagctctggtttcagaacaattcagataaaccttatgctctatcgaactggcagtgagtttgcttattgaaagaaaatcttctgagaatttctccttgcttgtcttctctgtagaatcagagtattgtggcttcagtgcaagtcctattcattatcattttgggaaaaataggaggaaaactttcagctttttcggttagaaaagaaagagggatttataagtgtcacttacaagagaaatagtgattaaaaggtgtttctacagaatctcccaaagaacatataaaccatcagttgggaactattcctaattatgcttcagtctttaatatactgttttatttttcagtattgacatttgtatttgacattgtcaactgaatgaatttatacaagcagaaaagctatagggcttatataatatctgattcttatgctttcagtggaggtaacagaaacagaaggaaacttaacaacatctaatcaaaggaatatagtttccctccttactgcaaatacaatccgattcagctatattagcaatgatatcccaagttgttgtgcttaggtttttagtcaaaatattctggaccctgatttatatctagtctgattttctttaatgcattcaaagctcagcattctctatatgcgacaaagaacatagcacatatgtaagacggggcgagggggttgttacttttacgatgctctcccaacaagtgtgacttcttcaatttgaagtttacagtaagacacttgtataccagcttaaagtgatttcacacatgaggtcagtagaacttcattttcataatcatgtcatgtatttctgtcctgaaaattccttgaaggctttattttatcttgtagcagtggtggacttcaaacatcgctgtttttgtagaaatgtcttattctttaatcaaactcagggtgacattaacaagctattttcacagctgacttcccagtgctggagctttctagtgtgttttgtatgttcccgctttgctcttcactttcgatttgtttatttttcatgacacatctgaatgccttcttgtaagcagagcccttgtcttgagatccaactgtggggttattattacaagggcacattgcagggatccttagtgaggggttaagagacatggttcagaaattattttcttttctgaccaaacatatgcatgatgtttttcctcccaaggagatagaagccagtcttgaatttctgaaagctctgagtatgtaggaccctggtgcttttgatgttatctgtctgatcctctttagagagatttatattattatcatctagctcaaccactagaagggaaagaccaataattcaaaagcttaagccaagacctataatgtgtccatgagtcagagctttaatcctaaagctgtcttctttatgtcacatggtcaagcttagtgacatggacctcaggtgtatgaaacggagacatctttactaatatgttacaagaaaattgctgagctctttcttttgagtgaagactacaaattatcttcactctatttagcagggatattgcctccaaaacaaattacttagactaatgctggcactgtccaaaaagtggcatacatctacttagtaaaatgagaatataaaggcataaattagcaaatggtagcattgtgattcccttctctatttcagattaatcacatttttttccaaagtgaaagagataagtacatgatatttacttagatccaacctccaaatgaatgtccattttaatttgtaagtgtaattctaataggaatatagctactttgcttataggcaattagagaattttgcttgtagacaaaattacagactttgcctgtggacatttctctatctgttacttatatgactattctccaacatcatttgacatgcttatatattttcccacagattaaaagtcatgcacaagatgaaactcatcatttattttctcctgcattggtgcaaagatatctgattcttctcattctcgaaacttgaaaatcaaattgagtagaaccaaatccagtaattatcagaaaatctactaattatcacacatttaagagtggacactaactttgtagctgtaagtcaaagacttttttttatgactgctcatatccagaagaaacatttttcagtctgtacccttcagtgaatgactgatcggtctaatttgaaattggacaaatgttgggtacagcatgatcatgttatgctgtgtgcaatatgctgacagattccagtgtctataatgagtatctttgtatgaatggtttctgatatgaaaagaaatttgcttatcaatgcaaggagaaccattggtatgttaattttatgcaagtatctcttcactttctaattcactcctcccaataatggaatggtaattggatttctgaaggaatatgcatagaaagcaatttaaaagtaatttgttaatcagaaattactccaaatttgtgcaataaaaatgaggccctgtagcctttgtccgaaaatgcaaaatgggcaattttccctaaatattataatttgagagaggtttacctaccacaacctataaacctcagtggtcatttaatttctaccattagagaattgaaagtctcattttatttgtgttaagcatttttccctcattttggccttgaaatgcaaaaacctaaattagaggtgttatatcaaacctttattaccttaatctttctaaatgttttccagttgtgtgtttctaagaggagaaaccggggtctctctgtgtttgtgtggtttaggttagggaagggtatgggaagtgtagttttgctatccttagaagtgggactgtgactcaggagctacgtgtctttggcatgttagttaattactcaaatcattattgtcttcgtatgtagaatggggctcacgctatctgttattagagtgtggtggggataatacatgtaacgtatcgtgtgtagcatggcacttggcccatactaaattgtgtcctcactaaaatctttaagatagtacttgtttttttcttttgtttgtttttttttcttgctgatttgtttgagtttcttatagatcttgtagatattaggcctttgtcagacatatagtttgtacatattttaggaatttttgtatatggtgagagatagggatctagtgtcattcatctacaagtggtattcagtttttccatcaccatttattgaatagggtgttctttccccagtttgtgtttttgtatgctttgtcaaagatcaattggttgtatctgtctttatttctgagttctctattgtcttccacttgtttgtgtgtcacttttatacctgtactgtgctgttttggttactatatccttttagtataattcgaagtcaggcaatgtgatgcccctagatttgttctttttgcttatgattgctttggctatttgggcttttctttggttccatatgaattttaggatttttttcctaattctgttaaaaatgacattattttgataggaattgcattgaatatgtagattgccttggatattatagtcattttcatgatattgattcttctaatccatggccatgggatggatggctttctatttgtttgtgtcacctctgatttctttcaatagtgttttgtaattctcttagagatctcttatctctttggttaagtgtattcctaggtattttatttttttgcgtcctattttaaagcggattgagttcttgatttgatttccagcttggttgttgttggtttgtagcagtgctactgatttgtgtgcagtgattttgtaacctgagactttactgaatgtattaaatctaggaatcttttggagaggagtcattagggctttctagatatgagattatatcattggcaagcagagatagttttccagttttgatgccttttatttctttctctggcctgatagctctggctaggacttccagtactatgttgaacagaagtcatgaaagtgggcatctttgtgttgtttcagttcttaggaggaatgcttcaactttttcctattcaatgtgatgctggctgtgggtttgtcatatatgacatttattatttcgaggtatgctctttctatgcctagattgttgaggggttcttttttttatcataaagccatgctagattttattcaatgccttttatgcatctattgagatgatggtatgatttttttcttttaaagttctgtttatgtggtgaatcacatttatcgacttgtatatgttgaatcatctttgaatccatgggatgaaacccagagccctcagccgatgcacacatacatggataagctcaaccaagatctgcagactcccagctgaactctgtagatgtgtaatgagtaaatgttattgcagaccactggtgcttcagacatttttgttacacagcaaaagtcagctgatacaaggaggattggagaggaaagaccagaaaagggggcgaggcttgatggctcgctcctgtaatcccagcacttggggaggccgaggtaggtggatcacttgaggccaggaattctagaccagcctggacaacgtggtgaaaccccatctctactaaaaatacaaaaattagctgggcatggtggcatgcacctgtggtctcagctacacaggaggctgaggcacaagaaccacttgaacccggaggtggagtggctgagatcgtgccactgctttccagcttgggtgacagagcgagactccatctcaaaaaaaaaaaagaaaaagaaaaagaaagaaagaccagaccagaaaaggggagggagaaacaggatttagaaaggaaaacagtgggagaccgaacatcacaaactgtgaaggagactgacagtgagaagaggaccacagtctgacttgggcattgttcttaaccttgatagagaatggcattcagtggagtcaattgctgggattggagcatgaatcaggttataagagagtgaacaaaagatgaagaactttaaacatgatttgtagacttctcttacccagaatttggcaagaaacaaaaggattgagagaggtatacggacaaagatctgttataaaaatgaaatggtgtcatgggcagtgtattaagtttttatttttcgagaggatgcatttaagcatgagtctaagttctttggttttctgggacctccaagagcacttttgggaccagctcagatatgtgagccaaaggtgcctgtgacttcaaaagctctcggtcagcacttggaaaaaggaaaggtgaaactgttagttaattgacagagctgttgggtcttagtcatcatgcacagtccctagtagtttagttgagtgagaaactggacatactgcctttcagcttggactatcatgatggtgccactagagagattcctcaaggaaggccagctgcaccatagcggctctcttttctctttggctagtttctccatcactgttttcctttttgcagtatgaaaacacaaggattgggtagttagttgagttgcctatgcccctctcatctttgcttttcacttgtttcagataagtgctctctatgctcaagtgattcccagaatagactgtctacttcttacagtcatgctgcgatgtctttccacctttgtaccaccaccgtacagtggagacccttggatgaccaggcactaaagaaatgcttaaagattgaactgagctaaaatatgagtttgagggttataagcccatacccaagacaagtaggaaacaccttgctagtaaacttgttggttctgtgtgtaaatgcagtaggcattcatatcaacaagaaatcagtgcaagccaggacgattggcattaacttcaagaagaggttgaacgtgcactgtactttcaaggttagacatcatttagctgaatgtgtgatggcacattatgcatcccaagtatttgtaccaggagtagcttgtttatgaaggacagagcaagtctgcaggataaggataaggcctggcagcagacacttgttactcacagatggcagtgaaaaatccaaagatattctggccaaagggttaccattgccattgactgtgactatcagggctgatgctgaaattgtctagttaatgtgactgataaatttttgtgagtgcctcagttcattcaggttactattacaaaataccttagcctgggtagcttatgaacaacagaaatgtatttctcacctttctggaggctgggaagtccaacatcaaggtgctggtgagagcctgcttcctggattgttgtctttttgcggtgacagaaggagtgggggatctctttagggcctcttttagaagggcactaattctgttcctcagagttccactcccatgacctaaccattttccaagaggccccacatcttcataccgtcacttcgggggttaggatttcaatatatgaattttgcagggacacattcaggttatagcaaggagtttgatgatgtttcctggaaatgtaattgcatatcagcttttttttttttctttaccagagggagtttttgtgaatctcttacttatttgaatagactctcttacttatttgtgtctgtctaaacccattgctttgaaagggaattgcatgcccattttgctagtaatcatttatatgaattttaatatacatttttagaaaataatttaattcttattttctacagtaacagaatatattctaaccctatttgcataatagtattatgcaaattttatatagatggaagtatgtttatttttattttgtaggatgcatatcataagtaattacttatagataaagtttaaaagggaaatatctcttcaaacttaatgtcacacaggagaaacagagagaatgggcaaaagatacagagatgaaggcccttcaggcagttatcagagatttcaaacgtggtaaacaatagaggaacctcagccagagggattagcattagtgaatgttcccggttctctgttttactcccatcactaccctggtttcataaaaggttagagctttttggcagtaacacagtgcctggcacatagtacatgttcaataaataattatatgtgtgaatcatgtaatgaatgcatgcgtgaatgaatgaatgatgatgactcatccatgtatttttctctcatttcttgcctggcttccattgcatccctagtttgctgaaatagagcattcatgaatcaactaggatttgttacagaaaacaaaaactatgggatataagacagggaattgggtacttaaaaattactcagagagctggaggagtaggactaaggcctgcttgtactattaagttcaagaaaactctgatctgggcatcgggaagttggaagctacaagccacaacactggacactgcagttgccctttgacaaccacctgactctcatgaccttccagggaggcacagccaaagcagcaggaagtgagctcacctcccttccccctgccatgactttcatcagtgcctgactcaatgccttgtgtgtattcaggttttcaataaaagacagttatttaatcaaatggcattaattaaattagtctgttattctgtagattcctgctttgctttacttgaactgttttttccagattacgttctttaatttctatgttgattagcttatttgatgagacataaaataacaaaaaagaataccttaggaataggcaggtgttctgattggtgggtggatgagcaaattgtttgggatcattgtctttattttagggagatatgaatgaaggatctagattgagtttgagctttgcacggtaattacagttgagatcagatgaccaggaaataacagcaggaactgttcacgtatgtttcttatttggggtacgtaacttgttctaaccaaatgggttttttacttacttagaaaaccacaggccacaatcattctcaaatttcagttcttctgtctctcatttatttctcttctttctactctctggcctcatttatctactatggagtacttaactgccatccatatagaaatacaccttttagttgctgataactgacattttccagctggtgaaacagaaatcaacaccacagtctgaagtctatgttgtctttcttgagaaacaaagactccctttctagacaaatttctgagagctggctctttagtattccagtattaagtgtatcatgtggtaattaattatgtattccatatatgtttagcatctctgcagttaattaatacgcctcctagcattttacagatttcataaaatgaaatctgcgaggaaagatctcttgtgaaaagcattgggaaagcctttatgtctttacttaattagtgtgacaataagaatcactcacttgagggaaatggcggcgtctagggatcaaggttattccaatgacttgattatttcttttccttttaaaggagtctagtctattcaaggttgatacaactaaaatctcagtagagattaaactcatagggcttaagcgtttgaggggtaaatgcagctctgaggaacagaatataccaaagtccattttaactactgcctttcaaagtttataaataagccagtgttttcagacacctttaaatatagagaactttaccaatatcagacaagtaatagctgcaggcaagcagcaagtgcgagttattgatgaccagctgcttttgcttctgctagtgtgttaaaaaagaatgaacaactatgacgtttctccactctctctctctccttcactcctttgttttacttctgaatgtctcagagtataaaagtaaggctctgtttcctatcttctggttgccaatgtgaagttagaattaaaatattaaacaggctttcagtaggagagatttaagaatttcctgagaaaattatggaaatcactgtcaccagcaatactttgcaagcacaaaaataatttattccagtgactctaacagtataagctactgtgtagcttttaaatataaacagaggagaacctggacaaagatgaatccctacaaatctcaggcagtattcatggaaagtagtgaaccggcttttgataattactcagcagagcagaagcaggcttccagtgtatttttgcctctgattttttttttcttttgtagtttatgacaatgagacacaactggaagtaagtgcgtggtgtgaatgtggaaactatgatcaaattgctgtgtatcttgccactgacaccatctgtatttagtctctatttcaggtccatagtaccagattttttctctaatgactgaaggttgagaacaaaagagtatttcttattgtgaagaggtctggtttctgttaggaagatgtattctgtccactccttcatttcatcatgaatactccattgcctgttcactttctttcttttcctcgcttcctttccttttttcctccttccttcttttcttccttttttaagccacatttttgaggtatgaaaacgctgtcctcatcttactgggagggatttcttatctaaggcatttgccttctttatcatcatagccttagggcctggcttacagtagttgctcggtaaatgttttaaaaatgaagacacatgtaagggcaaaaccgaaacccaaaaaattgttgcctaccttcctcaggtgcctgtccgttcataaggactcacctatttcatcaagaatctttatactcttcagaatacaccatgtttagaaactctcaaacctatttgtgaggagctgttagtgaaaggagctcagttctgtctcttgggagttagttcctgctcctggcagctcttagagaccacatggaacaagaagtcctctcagaagcttctattctgggatttctgcagagtgcaggtgtttgtgtgtggggggtgcatgtgtgattagtatgacttggtataatgcagatcaactgaaattgagttgaattttgtggtctgatgaaccatatacgtaattgactaattgaaggacaaagggcatacttgattggtggaattgacttttctatttatgtaacaggttacttgtgttgtcaggtatcacaagtatatatcatatatatttaagcaatgctacttcatgggtattttctaactactattttgactgatgtttctacagtagtcatcaaatgatcttaaagcttgtgtgtgttgtatcatgtgtgtgtttaaggagaaagggagaaaagcaggaaggttgtagacttcgttactcaatggcaactgtcttcgaggaacatttattgatgtctaatgtgcacactgacatgcatggaaattgtaaatgtacataaaggctgctgagttttcatgaacacacccatgcagcctgtactgggatcaggaaacaaccttaaacctttgcaggagacatttgatcccctcttatgcggctgccagtcactatctcccaagggtaggcactgtcctggtttctaacagcatagattggtgttgcctgtttttgaactacatgtcactggaatcccacaagtactctttgttgtctggtttgttttattgaacatcatgtccttagcagtgactcttaaaaatatgctgagttccacagcacctgatttgaaaaatgtatgcgtgctctagaccacaatagatctttttttaatagtcagtatctgctgtgataaccattattatgatttttaactcttcccacagggtaaaaaaaaattaatgtaatttgataagcagttacccagtgaatttgatcaacattgagcacaatgtgtatgcctcagactttgaatccttgaatgcagcagctgtcttctttacttaatctgatgttatttccagttatttgaaaagctaaaacgtagtattcattctgacagcagtttgtggttggaaaatggaaggtagtcactgactgccttctcagtgtgtgtgtgtgtgtgtgtgtgtgtgtacacacgtgtgcaagcatacttaactgtgttgtgatggtgagaatattatgtgcatgcggatgctctgcaaatatgaagcatgctatactgaaagacggcattgctgctcacagttgtaagctttacaaaaattatgtataaatcgctgtctctgtcttaccactcatgccaggagactttaattgacatatttagcttatgtgatctttttctagttgttactccaccctctgtctcactgccatcaagccttcagttaagtttttcacgtaagtaaaatgaaagagccgcctaatgtttggatgcatcagcaattatatgatttaagtttactctctccttcttttacttttataaaacctttagaaatgcagaaggtcctgacttaagatggtttgacttatgattttttgactttatggtgatgcaaaagcaatatggcttcagtagaaactgtcccttgggtacccatacaagcattttgtttttcactttctgtatagtattcaataaattacatgagatatgcagcagtttattataaagcaggccttgtgtcaaatgattttgctcaattgtaggctaatgtaagtgttctgagcgtgtttacattagactaggctaagttacgctgtccagtaggttagatgtatttaatacatttttgatgtaatgatattttcacctttcaatgggtttattggaatgtaaccgcatcataagttgaggagcttctgtaatagaaatttaagctaatggaaaatgcaaataagaaatcacccaaaactaattatattttaaaaataaagatatattgctctttccatgttcattacaagtttggaataggtcctgaatttaaatataattaggcagcgcaaaatagggtatgtattacagggtcaataaaatattgacttttaaggaaatccagtcgccttattttaaatgttgttaatctgaatataatcttaattttttataataatagacagatttcccctcaactgatttttcagaagctttaatcagctgtctcttgaatgcttcctcatgctcccagcagtttcaagtttgtctcatttatagtatcatgtggattaatattatttggtatgatgcagatcagctgaaattgagttgaattttgtggtctgatgaaccatatacttaattgactagttgaaggacaaagggcatacttgattgatggaatctacttttctatttatgtaacaggttacttgtgttgtcaggtatcacaagtatatgtcatatatatttaagcaatgtttcttcatgggtatcttctaactaccattttgactgatgtttctacaatagtcatcaaatgatcctaaagcttctaaaatgattcagaacctgaatttcacaattaattagccagccagctctctcaaaattcaattcaatccaacacagctttattgaacaccttttgaatacaaggcatgggattgatggtaaaatgcaaaggtaaatgaaatgactttcctgacttgaaagagtcatgttcttacggaggtcagaagactctagaatcaattgatgagatctttcatggacttcttgaaagaccaagggagtcacatcaaattgtgtgattaagtttccctcatttgcatgaagacaatacctgtacttgctctttttttttttttttttacaagtatatgtagtatgaggatgagagagatgtgtatgcaatgggtttatcattgttaagctatctctataattaaaataattgtaataaaatagttgcaattgtcatagtttatttaaagaaaaaatatggtgcattatcttgtatcattttcctagttagaaagccttgtcttcagctctttaaagagggaggtgttcagaatccagaaacgataaggagaaaggaaggaagaagaaaacatagttttaaaaagaggtgactcgattttctactgaaatgaactatctcctttgaactactaaggaaaataaagcagtatttttcttaggccgtatcctaactgcttgctcgctgtgaattatgaagctttaaagcagtaaagagaaatgtgtgcttttctcaagtgactagagagtgaatgctgtgcattgtttctcacatgtgatgttaagttagagcttgcttcacagactccactcgccctttgttcttgaaaagtcttgccatcttggctgtgagtctggtgaacccttttttaatggtcatacaacaaatactgtagtggttgaaagttggctgctttcgcattgcttcagagtctgtgtcatcacatttgttattaatcaggaacataattatatttgaagcatagaaaagaaaccatttatcttggcaggatgggatgagacagtcgcaattcatatgcctgtaaacccaccagctaagtcaaatcactattgccagctcaatcgttttaggttaacctggaggcgaaacagagctgtcaacaccattaccagttagaaagaaaagacttttcctgccacttattggcataaggaacaattaaagtatccccatgcatatgccaagagaaaatttccactttgtatgaagtggtggccatgtaggcaatgaataaaaataatgataataaataatacaggaggtggccaatagcaagaagacttgtatcctttggctttgtgtctgaccttgtcacctctctatccctgaaatagccagtggcatgaccaggaaagccagagtacctcctcgtgtatagttctagtttagagcttgcttgaagcaaccacagtaataaacactgtgtcagccagcagaatgtaactatttaaagggtccgattggcagtgagctgtctcaagtgtcttctgtttataatcattcactgaagtaaatgtttcctattatatagacagcatgtggtaggttactgaacttcactgcctggttaaagtaacgcaaagaatgtaaaaatctgggagccattgaactccttagctacctcttcaatatttcagtcaacctttacatctttctgtcatgaggttgcccctgtggcagctctcttgtggcgttggctgttttgagctattgcacgtgaccaagggtgttataatctgaattgcctttgacagcttgccaaggttgtacttggaataaacatgttagctctgaacaggtaacccttgagtcccaagagcttccctgggtcaatttcactctcatcaaaccaagagatcttttcataatggaattatttctgacactcactacagaatgagaatacacccatatattttcactgcttaactgaagaggtggttctgaatcaagtgtttgtttgctggtgtcatccttttcagttatttctcaaataacagatgtttttctcttgcctcaagttctttagtgtcatactagtgtttatggctaatattgattcaaaatttgggcagaggctccttttccctgtctaatttagcatcctatttgctagtaacattagatcttaaaaaaaattcttttaatgttttgcctgacatgggcagtgatgaattgtagcacggccaagtagttttttatgcccttgcactcttggcctaggtgtgctgggcagtccattacttggtatacattagccactccagcacatactggattgaatgaatgaatgatcaactgaatagatggagttataatatttatgttactggaaaataaggtgttcagttgggccatggaaagaaatgggttctctgaacagcagggaaaagattgttcctacaatctcttgggtgcctttcgcaaattcatcattcttcaatgtgctttttttttctttatagttttccttaatgtacaattcccctgctttatgaaatcacattaggatggaagcatttatttagttttgagacctttatgtccgtcaatttatgggcatcaatttaataagtttttggaggtgcatccctttcctattgccactataacaaattaatgcaaactttttcagcttaaaatgacactcattggttatctcacagtcctataggtcagaagttctggtgggctttactgggtcttctgcttagggccttaaaaatctgaaatctagatgttggctgagctgtattctcttatggaagatgtgaagaagaatgtacttcaaaatcattcagatctttggcagagttgtttcttgtggttgtaggactgagatccttgtttcatcactggctgttagccaggagccactctctgctctaaaggccagctgcatcccttttcacatgactccatccatcctcaaaccagcaatagtgttggagtccttttcacacttccagtctctctggcttccccctttgttacagcaagagaaaattttcggtttttaaaaacaaaattcatatgattaaacccacttgcgtcatctccttttcttaaggtcaactgattagtaaccttaatgacactggcaactctctttcactgtgtgatataacataatcactggagtaacaccatggggtaaaggtcagtgagtccaccttagaattagaattctgcctatcacagaaggtgggagagaagaaataccaaattatggtacagccatgtttgtttgtttttaactgactggtggtggtgtgcatttctccatgcaacattataccttctttttggcatcatagtccatgttggagcctcgtcctcttccagagtctgaaggaggctctgaatcattgataaacttgagcagttactctgagtatcatggtgacatctcaagaacacctgatcttgactctgtggcagctctgggcttgaaaatacaattttgagacatattaaagaatactgaggttttatgcacattttctgttaggttaaggttataatttgtgtttcactctcttgacttaagtgttgctgagactaaacagtttctctgaaaagccagctggaagtactagactgagaattcttcatgatgcagtttgctcttcttgaactcccctgactttgagaattctgtggtactttcctgagctatttggcaaattcttctgcttttagctgcacttcccagtaaatgccaacatgcatcatattctgcaaacactattaacttttgtttgtccagcatttaactctttgtggcatgcactccttggcttcccttgatgatatagtcacctttaatggaaggaactaaagcagctttataaagcaggaagtcatgttttgtaactcagaacaaggaagcttagagcgtctcatattgcaccttctctttgctccagtggtttcatcatgctgctgccaaatggttcttctaaaatgccatctgcatcagcatgccattcctctcccaagcccttcagtggctctctgctggctgctaaatcagcttgaagcatcctggccaaatttatttctcctttcattaaagtttctgctatagacaggttacatctcaatatttttctcttgagtcacatttttgaacctactatatacctaagcactgtacattttatgttgcattatcattatgtctttagatatttggtcttccctgcaagagtccaagcttcttaagcatagtaatcatgttttaactaccttggtagcttcaggatcctgtagaggtctgctgagtggtaagttttcagaaaacaatggttaaatgtatttgaatgtatgtatcaacaatgtaaacctaaataataaacagggagaggctctctaaaagaaaatgatatttattcaggagtaggcattgcaatgggaatatgtgtaacatagtaagctatgtatgtattcggggaggtgaaggaaagcagaggtttttagagaaaaaatgaggaagattacattattgtttgagataattatcctttgccactagcatccagcaataacaagggtggttccagtttgaggctggacaggaaggtactgggaagatgtcctcactgaagtattttgtttaaggttgagatggcttttatgtgaggttgtgttttctacagtcttttatgatagttcttgttatcaggcattcgtgcatgagaaccttctcatggccttccctagctctatttgttagaggttttcttgtttgttttaaacatatgtgactgcattttgatttgggcaacattcacaacagtttatttaataaatatttattgagtcactactgcatcctgcaccgtgctaatggctgaaagatgcaagatgaataggatgtgacttctgcccttgagaacatcctaggttcctagagaaagacatgcattaaattgttctgtgatctgaactctaattggtgcatatatgagggttgaacacagaatttagagcacctaatttcacctggagggttaggaaaaggctaggaggtgaggaggtgacttgtggtctgtgtcttagtgtgaggggtcattcacaaagtaagtcaggaagctaggatgggtgttggagagccatgcccgggagagaatgcaggatgtgcacaaccacagaggtatgtaaggatgtgttgactcagggaaaggtacctgatttgttagggcctcagtattggggtgaaaatgaggctacaaaggtaggtagaagccagattacagaaagcctcaagtgccttgaactttgtccagaagacagtgagcagccatgagttttaaggaaggaacctgatgagatttgtattttatttttgtttgttgattctttcacatgaaccatggaagacaagttttacccatgtctcctcctggccaggcagccgctgaggtgctcacaggtcatgccttgggagggtggactggagaacagggaggcaggagaggccccgcctcacctgtcccctcccctgttgctggactgcagctgccttgctgcctctgaccggcagagtcccaggcaagctccctcctggacccacttcacagcttccatgccagtgctccatgcccatctccttcctcccctgccatggcttcaacctcactgccctcctccagaatacctgagagtgtttctgcttaaacatcttctttttcccatagtataatgggggcacaataattactggatagattcagccccttggtcccaggctctgctcttttaactttggatttaactgatgcttgacagaatacagagaaagattggtctcatcttacatctttccatgccactatttatctcctcaaatggaacaactggagatgctaaaaacccacttcttgaaattacaggacagaaaagaacttgtagtacttcacttccctggcacgtcttgagtgccatagacacttaatagtggctcatgcctcagtggagaactggggaaacaaattgtagaaaccaaaatggaactagagaggatagaaagacagatagtatagcagcttaaggaaagagactcaaatctttctagaggtttcccatctttgattcctcagagcatatattcttgacaaactgcaaaatgattcaatagatatgttatttttaaattaaaaaataaaagtgtcttcaaatctttgaagtcctgttgaattaggataagtagacacaatgaataaatattttgaataaaacaaaccatatagcagtcatggcaaataaaggaggtcccaaagaggcttttttagagttaaaatacaatttcctggccagtcttctcagccccgacttagaccgatactcatcctggtctttgatgagtaaatttgctttggtttctgatttataataacttgacaaaaagaaaagtatatcttttaaataatctactttttgcttttttcaatttatttcctccctttttgttttaaattgtttccacaggcacttgatattacatacagttctactttggaaacatagcatcacttgttttgcctaagcaatgttataaaacatttttatctaacctacacttacttcagcattcttttccattttcctcactctctgaaaagtatttttttttccattgcaaagcagctgaggaacaagagtaaaaatttattataacctggaagaaaaagcaggattcagccacagagaacactcacagtgggaagacaagtaggaaatatggcggagcaggagaggatgttctgagaggtgggaagtaagatgaagatgatgtcatctgtgaaacaaaaacaagaaagcaaatcaataaacataatccatcacataaacagaaccaatgacaaaaaccacatgattatctcaatagatacagacaggccttcgataaaattcaaccccacttcatgctaaaaacactcaataaagtaggtattgatggaacatatctcaaaataataagaactgtttatgacaaacccacagctaatatcatactgaaggggcaaagctggaagcattccctttaaaaacccgcacaaggtgaggatgctctgtctcactactcctatgcaacatagtgctggaagttctgaccagggcaatcaggtaagagaaagacacaagggtattcaaataggaagagaagaagtcacattatctctgtttgcagatgacatgattgtatatttagaaaaccctattgtgtcagccaaaaagccccttaagctgttaggcaatttcagcaaagcctcagtataccacatcaatgtgcaaaaatcacaaacattcctatacaccaataaaagacagagagccaaatcatgagcaaactcccattcagaattgctacaaagataacaaaatacgtaggaatacaacttacaagggatgtgaaggtccccttcaaggagaactacaaaccactgctcaaggacataagagaggacacaaacaaatggaataacattccatgcacatgctccttcatgcttgtggataggaagaatcaatatcgtggaaattgtcatactgcccaaagtaatttatagattcaatgctattcccatcaagctaccattgactttcttcacggaattagaaaaaactattttaaatttcacatggaaccaaaaaagagcctttatagccaagacaatcctaagcaaaaagaacaaagctggaggcatcatgctacctgacttcaaactatactacaaggctgcagtaaccaaaatggcatggtactggtaccaaaacgggtatatagaccaatggaacagaacagaggtctcagaaataacaccgcacatccacaaccatctgatctttgacaaaccttacagaaacaagcaattgggagaggattacctatttaatacatggtgttggggaaactggctagccatatgcaaaaaactgaaactggaccccttccttacaccttatacaaaaattagctcaagatggattaaagatttaaatgtaagacctaaaaccataaaaacccttgaagaaaacctaggcagtactatttaggacataggcctgggcaaagacttcatgactaaaacatcaaaagcaattgcaacagaagccaaaattgactaatgggatctaattaaactaaagagcttctgtgcagcaaaagaaactatcatcagagtgaacaggcagcctacagagttggagaaaatttttgcaatctatccatctgacaaagggctaatatctagaacctacaaggaacttaaatttacatgaaaaaaacaaacaaccccatcaaaaagttggcgaaggatatgaacagacacttttcaaaagaagacatgcagccaacaaacatgaaaaagaactcatcatcactggtcattagagacatgcacatcaaaaccacaatgagataccatctcatgccagttagaatagcggtcattaaagtcaggaaacagcagatgctggagaggatgtggagaaatagcaatgcttttacactgttggtgagagtgtgaatgagttcaaccattgtggaagacagtgtggtgattcctcaagaatctagaactagaaataccatttgacccagcaatcccattactgggtatatacccaaaggtttataaatcattcttttataaagacacatgcacacgtatgtttattgcagtactattcacaataacaaagacttggaaccaacccaaatgcccatcaatgttaggctggataaagaaaatgtggcacatatataccatggaatatactatgcagccataaaagagagtgagttcatgtcctttgcagggacatggatgaagctggaaaccattattctcagcaaactaacgtaggaacaggaaaccaaacactgtatgttctcactcataagtgggagttgaccaatgagaacatatgggcacagggagggaaatatcacacactggggcctgttggggggtgggaggcaatgggagggataacattaggagaaatacctaatgtagatgacgagttgatgggtgcagcaaaccaccatggcacatgtatacctgtgtaacaaaactgctcgttctgcacagttatcccagaacttaaagtataatcataaaaaaagtaaaaaaaaaacaaaaacccaagaaagagtttcacaaagggcagcaggatggtccataaatgcaaaattgtcttgggatttgacagtggggaagtgattgaggattggggagaagattcagaggattctggaatagacagcacagctgtaagattaggaagagattgggtgttgaggaaagagatcagtggttctcaaaatttacttaagaatcatcttgaaaacttgttaaaaatatagattactgggccctacgcaaggaaacttcaatccagaaggtctggtatggactaatgaattaacgcttttaactaagtattccttctgattctgaatattaggtagtctatggaacaccttttgatcaatggtatggcatagacaaccaatgtatcctgctgcttctggaagtgaatcagggaaaggaaagtaagagacaaagtggtgagtagaagcagtagtaaggtgatgtgaaggtccagccaccaccctgaagaagagattctgatttaaaaacaaagaggaaagtaccagtggtattggaacacagcaagataccagggagggcagggacaagtgtgagaccagtattcttacagtacttctcaggaaaaaaggaagagcatagcagttaaattaatctttagtgagagttggggacccagcttaattgacaacgaatggaggaaaacatcagagaaagtgtggcaaatggtgaccgacttccctgtgattgttgtgtttgtgaccttgctctgtgtagagcagcatttagtccccctcatttgtacatttgcatagtcatgtggccatcttgattgcaaacatgattcaagtcgctttttagactttcactggatttatggagtttactttaaaatccaaacatataaagttgtggaggttttgttgtgtttgtcttgtttttttctataaaagtagtcagtgttcactgatatgtggtgggcatgacagatgggccaggcttttgtgaaaaatatgaaagtgactgcaaattatgtataccagtatattttattagaatactaatgtagataaaatctctcaatgcatatacagatggtcctcaacttacaatggtttgacttacgattttttacttcaccatggtgcaagaatgataagcattcagtagaaatgcatactttgaattttgaattttgaccttttcctggggtagcattatgcgttacgttcctcgtacatgaaatattcaatactttatttttaaaataggctttgtgttagattcttttgcccaactgtaaactaatgcaagtgttctgagcacatttatggtaggctaggtgatgatgtttggtaggttaagtgtattaaatgcatttttgatttaacaatatttttcaccatatggtgggttgatagaaatgcaaccccattgtaagtcagggagccctgtatattacataactacaaattctacacttttagctacctggagagaaaaaatatgtaatattggtcgaactagttttgtccccgcatttttaaaactttctcaacagcaagctcaaatcaccttgaaatctgaaatatattttgccatcaatttataggccgttgatcatttaaaggaaataaggtatctgtcataatttatttatgtagtttatgatcaaaattatatttctgaaatctatttgatatttgagacatattttagaccaggctaattaactcatttctacctaaactatttaaatatagataagtgtcttttaacacttaggatttatttaggcacacctgactgaagaattatgaagaatcatgagatagtatttaatcaataaaagtattaccatctcctaaagtcattatttccttgcacaattgtgtattagttttactaattaagaatactacatttaaaagcattactaaaatcccctatgtattttgatgttgctttagttgacttgttctcccttcttccctctcttcttcccttttcctcatttctgtttgtctccattttaaatctatcttattgttgcggctgcatccttcttttattattatctttttttttaagtaatgttaatttcttgaagtatattttgctctggatttttggggacaggtctctttcccagaaaacctagaggagtgggtatctgttgacagaaatcaaatatcttaaacatcattaacggaacagattgtggcatttgttgaagcttcttgtgctgtcttcataaacaggtttaccatctgacttgccattttacaagtcctgtaaaacctaaatgtaaatctgacagtttgtcagtttgtaagccgtttgacttatgctttaatgatttctattttgagggagttttacaagaatacatttaacttggatgatgcagggaggtaagtatggccccaggatgggaaaacataccatttcttacaactgtgtggcaatgacattgtttatgtgtatttatacatactgatttccctggaccattgtgcggcctctaaaataagaaagtaaagttcattttaatagaaacttattttgtttcaggtttattcccagtagccaaaatctttgagaacctaaatgccccggctttcttcataattgccctaaatgagaaaaatgtattcaccaacttggagcaagttgtattaacttaattttagttaaattcaataaaggtttgtttggatctgtaataatgtttactgatttctttaaaaagtaattatagttctgttgtcctctgtgatgtctgtacttcctactgaatatttacaagttagactaggactcctctagcctaacttgtaaatcccccaaaatacgtgggggatagggttagttctgttgaagacaggagaatattgattgtgtgagaagagatgttttctcccaactcctctagaagcgtagagcgtggcaattcatgcaactacaccataattttcctctcattttttgatgaagcttagttttcacaataaattgcctctcaactctcaagagattacctgttgctagttggtcaaaccctagcttaaaaatggcagcaattggctgggcgcggtggctcacacctgtaatcccagcactttgggaggccgagtcaggcggatcacgaggtcaggagatcgagaccatcctggctaacatggtgaaaccccatctctactaaaaatacaaaaaattagccaggcgtggtggcgggcgccggtagtcccagctactcaggaggctgaggcaggagaatggtgtgaacctgagagacggagcttgcagtgagctgagatcccaccactgcactccagcctgggtgacagagcgagactccgtctcaaaaaaataaataaataaatggcagcaattacccagtttgtgaggataacctcattttaggccctgcagtttgtaatcaccttgctgagtaggtttgttcatcttataacactgggatgatgcaaagattgtttttaagcttggcttccaatttcacaagcactctaacaccttctagaagttcttattttctcagaagatctttttgcaccctgttatgatctttcccactgattaaactcctttctaggtgttcatgggggcacataaagcctacatcaaatttgatgagtaccttggctttgaaaacagcgaagcacaactgccaaatacgtaacaatacatgtttttaatacagcaatttaaaggaaagccacagctaaaaccatcactgaaaatgaaaatctaccactagatttggacaaactatttatcttttttttttttttcttttttgagacggagtctcactctgtcgcccaggctggagcgatgtggtgcgatcttagctcactgcaacctccacttcccgggttcaagtgattctcctgcctcagcctcctgaggagctgggactacaggcatgtgccactatgcccagctaatttttgtatcttttagtagagacagggttttgccgtgttggacaggctggtcttgaacgcctgacctcctgatccacctgtctcagcctcccaaagtgctggaattacagacatgagccaccacgcctggcctatagttttatacaattagcatacctcctgatattaacattatgatagcaaaacttgttagatagtttaaaactcccattgccaactatacattattttcttagttgattattatttattattattttaggagtctagaaaaatgtctggttcatagtgaaactgagttatcttacttggttcagattgatggactaaatcgtattgttcctttgaaaatgcaaattttgctaacaagaggagaatgaattcattgttttacagatttgtatatgatcccatgagtactcaaaactatagaatgacacagggccatttgggaatataaaatgagaaaatttctatattatgtctgttacttaaattacttttataaggatggcatagaaaatgatttccattctatgagaaaatatgtttagaaataaaacaaagatttctatttcaaaagagacaatacagatagaatgagtcattgtttctttttcaccataatatcttttacaccatagatttcagtggtttcaaaaacatggttatgatgataaactaggaaatgctgaagcttatcttttactgtgggctttcctcaatagattcttcccttctaactatattatttcaaaggtagagttaaaattttatcctggggttttaattacaccaaatagaacttagcgtgcatgaatccatgtgtggcagaaagatgataaaacaaagcattgttacttatatatagaagatatcatggactggccagctgggcgccatctgttttgtttcctctatttgtaaattgggataataacagtatctacctcataggattgttatgaaatgacataatgcgtgcagagtccttaacagagtgcttggcgcttagcatgtgctcagagaatattcaacagtgaccacaccaaaggcatcagcaacaaccccaacaacaacacctggacaaagaaaaattctcttgcttgaagcaaatgtggtataattatttaaacgttatgttactttcaggagtatgaggtgataccatggactgtggcaggtgggaattgtaacttctctcagagtcagtgtagtcagaccctctgcaagctcatggatgaaacttttcaactcagcgatgtctctggtctgacttttttctttctaaaaattatagtgaaaatacattggaagaacatcatattctactctttgtcggtatcaagtaacattcatttgcttaaaaagtgaaccaaaaaattaaatattaatatacacatttactttatgggatataatctaaatatagaggtagatttctaaaaattaaaacatgtgaagcatgtactagtgaactgcagttggattgttttaggaggtttgtagataccggtaatgaagaatttgacaccatttcttgatgtttgatcattcataacttttaagtcttctatccacatctgggtaagctgataagaaagccctggtgctttttcccttgtgccagtgaaaagccacacagggaattctcatcctcatcccaccctctaatcagtattttaaaactccagcctaggttccttgtcttgctctcaagccacttctgtagctgcttttgatgcctctcctgctcccccagaaggcctcattatgtgaatcgtaaacattttcatgccctcttggtatgagggtgcagggaggcatcatcattctcaacattggaaccgaattttgggtggacgtccatcttcttccttcggaggggccacaaaattactggatataagtttatgatcagagcttcttagctacatcttgtgtgttgtttgtatgttctaaatattgtcagaagaaaaataataagcaaattcttacttcctctatgaatcatattgagccctttacatgggttatctcatttaatcccctcaagagcctttgatacagagattctcattgtccaattttcgatgataaaactaaggcagagaaagattaagtagcagtcttaatgtcacataactagtaagtggccacttaggatttgagcccaggcagcatggcttcaatgcctcccccttcatataaacctaatatacaatttttacaaactactttatgggaacagtcatctttgcatttcctgttttcagctcttacatatttagaaaagattacagtgcatatccaaagctctgtgtatactgtggtctccagcaaatcctatcaaactgagagcagggctggcttctttggcttgttttcttcaaagcaagcactggtctgactcctagcaggcgaccaataaatgcttctaaaagtaaaatactatgcagatgttcagatataggtgctttctgtcttctgttttgttcccccctcttgacttcttttgtcaaactgttgatttgtgcttgtgtgtgaaatgtgagtcttgaaaagtcagtttgaataatagaggatttttaagaaagtacacatttaaaggaaaatattatttctttgataaagcagtaataatatcttagtgcttagcacttcactggtagcttgtaatacaggcgattggatgacacctgtttgtacatgtgcctacttttcccattcaggtattgacgcccaagaatacaaaaccagcgtcttactgaattctgtatcctctcccccgctgctctaacagaagccttcacacatggggcatttctcaatatatgttggctaagttattcaatattgtccaactaagtctaaaatgtatacattgtgccttggagaaatagccaccaagtactttcttgttgtatttgctttgtgcttatcaactgtggtccttgcagtgtggtaggactgttttctccattgcctaaagtcccatagatggtaagttctggccctgtgactcatctccagccatcaacctcacaccaacagaacaggcataccctccactgtgcctggcgcctctctcccttactgtctaaagttcaaatcttggaacctaaaactcactaacccttgggagtgatattttttaatgtcctcagctgagtttattacaaattgacctgataatccttgtttaaatatgggagaaaatatgtaatttttctacctgaccctacttgctccctcatctcacacacacacacacacacacacacacacacacacaaaaacccttctcgttaaagaaaggaaagaaattttgattgttattattattgaggagagataaaattttaaaaactcttttccaaactggaggtagagatggttaggaaaagaaagatattcttcctcaaagagagaaaggacagaagacactgggctgctgggcagaatttgtaggcactctgagagagagagagggattgggcaaaggactgcctgcaccacatcgtggaaagtgtttacacccagtggtcagtgattggtcctgggttggattgccagtttttactaaaaatagcggaccctctgtgggcaagtgacttaacctctgtgggtgtctttctcttcatctacaaaacagacaccaattcttacatacacagttgtgaggagaaaattggatacccttgcgggcggcttcctgtgtccatggaacataacttctctgatccgctccatgctgacaacatgtggactagcccagccttcagtcccaaactcgcttttcacctcaaggaagtcagaaggctctccaactaagctttccccacaaatggaagggcaacgaatgtactcattgtatccaaatacctgtaactgacaaaatgacgtagtggaaaggaaccttgacaccctaattgaattacttgtcaatttttgtaaagtgtgcttgttttccagaggaaatccttttttttttgttgaagacaaactgcagtattcgttacacccggacagtctacttttgtaagacattttgggttttgccaagtgacaccctgacaaataaaagtgggaggtagagacaaacctcatgagccaagcattaaagacaagcctgaaagccaccaagtttctggcactgtggagactttcccaacacaccaggccaccctgagccacactgagtcctccccagaactcccctcaagcacagctcccttctcaatgccagggcaatgggtagtttggttctacaattgtgcattacatggagctcattgcagtgggcagcttcacagctgaccaaagcccagaccctggtgtccaagttttccagtcaaatgtgagacaaaagcagctagacagagactgtccatagaatgtactgagtgcagacagagggagactgtagccctggaagttacatgagtacagagaatggagacctcttggagacttcaaggaaagctttggaactgacttttgctctaaaggatgaatagagagaccttgccctgcccccattgcacagaatgcaccaggctgctccagtagctggaatagcatgaccagaagccaagatgacaagacagagcaccgtggggcccagcaggtgggagagcaccacagagcttcttgtgtgaggtcacatcttggaggggagatggatgcaggctatggatgggctaaggaaggtcttatttgccatgctggggaatatagacattatcctatcgggggaggcatgttagagctctctcactggcgacttcatggaggattggtaatgggcagggcagaggagtatggatggaggcagggagatcagtgaccagttagaacagcatggccatcctccaggggatgggcattgagggcctttggtggggctatgggagtaaagagaattgtacaagctgcaatggagggaagtcagtggcctcaatttcacaaaagaaggaaaactgagtataaacttcacattccccccatcctctcccttacttgtctgtacctgacacatcatatataatcctttccggcttttcataagcttatcattcttgtaatgattttatgctaagaaattgaattatttaagggtaatatggtttggctctgtgtccccacccaaatctcaccttgagttgtgataacccctacatgtcaagggcaagaccaggtggagataatttaatcatgggggcagttacccccatgctgttctcatgatagtaagtgaggtcttatgagagctaatggttttgtaaggggattttcccctttttgctcggcacttctccttcctgccccaatgtgaagaagaacgtgtttgcttccccttctgccatgattgtaagtttcctgaggcctccctagccctgcagaactgtgaatcaattaaacctcttcctttacaaattacccagtctcgggtgttttttcatagcagtgtgagaacagtctaagatagtaacgatggcatatatttaaaaatttggttataatctgttcctatggagttagaagaaacctgtagagaggattgtgggtgttaatgaacctcgtatgagtggatcggccaaatcacacttggtatgaacacagtgatttacctgctggtttgctgtgatgaaactttagccatttgatttcttaatggagggggattatagcttaatatctagaatggagtcttcagcacgcgtatgctatgtcctcaaaatagaaacttgctcctttcaaatatctgtctctgagggaccagaggatcaggggtggaaaattctgagtattttcaaatccagcccaagtatcatcacactttgtaaaaacgactcagcataatgaaggagtcacggtgcctctgacttcatccaggatatggaagttattgttatattcccagtgtttgagactgtttttgcatatataaaagttagaatggttttcaaaaattggctattttaagttcttggctagctcctgcacatccttcacatttcaacacatgtgttacctcctctgagtggcttccttcaactcctctaatcccactgaaatacctcccctcttgtcacatatttggcaatttgtattgaattgcctgtcatctgtcttcctgactagactgtgaggtctttgaagagagggactgtttagtttttgtgctttcatcacctagaacagtgcctggtgtagattaagcattaggtaaatgaatggatagaatctggattctaccgtatgctggctcctattgtgctcattttgacaatttagttctgtttggttggttggttgtttttttgtttttctttttttcctttttttgtgtgtggcttaaaacatagttttgtattcatgtttcctttcaacagcaattgtgttagaagtagaaaggttgttggtgaatcacctggctttccttggattatataaagaagtataaattatactatttccatgcttatgaaatgttttacttgggggtctatgtttacatcaatagtttaatgtcaagcatacaaattattttcatccactactggcgaatccatttgaccactggagtagaacctttggaaatgtgttgcaatagactatgtggtggtcaagatggtagctgcagttagctgcatttatcatgcaggttcatgccttacataaatctctgaatttcaacctgttttttttttttttttttttgtaaatcacaaaagacccatttgtagctttagtttaaaacaatacaatgaaaaaacttttcttaagaggaaataatgacctcaataaaccttgaacaagctcccttatggttttaattgtttacatttaaaaattgatgtgcatgtgtgtgtctttgtgtgtgtgcatgtgtatttgtactttactttgatgtgagagtgtaaagtgagaagcatttaaaaatttataatagaaatgagattaatattccatatgacagcaaatacttccagcagacaatgaagccaacagtttctacttttcacttaatctttctgcaggatctaattggtcacaacagtgggagaaatagtcactagcattgcttataacgtatgtcatatctactctgctttggagaaggaatttttttcctgccccacctaaaaactagactagaacttaacagtatttctcaaaggaaggcagctatagaatcctggattttggctggcggtcaaaagaagagtttccttcaggtacttaaatgaatagtttaaagtgaaagcaaagtttctgaaagtcctggatacttaccattcagccaaggtctttcttgccgagcaccttgagaatgtgctgttcatctgtgcaagctgttaaagtaagaagcaaagtatcaatatggggccagtgattggcatctggttatcactctcttgagcctgcctcacttaaaaggctactccaggctcattaaatttcacagttttcatagccaccatctgttcgctagaaggaattgccataccattccatgactccagcatattttccattatgctggctttatatagtctacatttatgggctctctttggcatcagcatccgagacaagtaggtttcatttctccttaattatgcttttactccagggttttagcttagaagattccagtatgatcatgttccatgacttcctcagacttcttttcatcaaagggaaaatggctgcagtttaaataattttaagtcattacagtagtgggcagttgcagtgtgactcttcaaaaacacaaacaaatatgctttttcactttcgaatatggcaatttttttatcaaaaattggataatttatgaatttaatgaattcttgggacaattacttatgttttgaggaagtcaaaagaaagttcaatgcttactgttgttcaaaacatttcttgaaaaacaataatgtctatgcagctcagaccatttccctgtgccctaaacttcatggctgataaacaaactcatctcatccaaaacttaattcatcatttttcttcctaaattgttctttcttctgtgagtggcacaaccccccactcagtcaaatccccaccaccatgatcatgcctattctgtcaatcatgaaccagctcaattttacttcccatcactttcttttgttcctggctctctattttgtaccatcatcctctttcactgtaactactgcaatagcctcttaccttgcttcgctgcctccaatctccccaatccattcaccttattgcattcagaaggatcttcctgaaaataaaagatctgtgcatgttatttgccttcttgaaacacttgaatggctgaacaattaggtgacttacacactcatatttcttctccagcctcaacattttctctcacccttttcagttctttagactttagctttgaatattttcccctaggatgattctctggtctcctgagtctgagtctggagctctctgaggccctgggcactcattgcttcccctaacataagacctaacaaaaaaactgtaaaaagagacaaagaaggttattatattatgataaatggatcaattcaccaagaatatataacaattgtaaatatatatgcacctaacatcaaatcatatataagtatataaagttatttttaatagatctaaagggtgctatagaatgcaatacaataatagtaggggacttcagtactctactttcagcaatggatagatcatccagacagaaaatcaacagggaaacagtggattttaataacattatagatcaaatggacctaacagatatatatagaatactccattcaacagcagcagattacactttcttctctagcacacatgaaatagtctccaggatagatcatatgttaggccacaaaacaagtttcaataaatttcagaagattaaaattatatcaggtaactgttctgaccataatggaatgaaactggaaatcaacaacaggaagaattttggagaattcccaaatgcaaataaattaaacaacatgctcctcagtaaccagtgagtcaaataagaagttaaacaagaaattgaaaaaacatcttgagacaaatgaaattggaagcacaacataccaaaacatgtgggaagcaacaaaagagttctgagagggaagttttatagaaataaatgcctacatcaaaaaagaaaaatgatctcaaataaacaatctaacattatacttcagggaactagaaaaagaagaacaaactaagcccaaagtcaatagaaggaaggaaataatgaagataagagcagaaataaatgtaatagatattagacagacaatagaaaaggtcagtgcagctacaagtttggttctttgaaaaggtaaacaaaatcaataaacctttagccagactaagaaaaaagagagaatactcaaataaatgaaatcagaaacaaaagaggagatgttgcaacaaataccactgaaatacaaaggatcataaagtactactatgaacaaattattcgccaacaaattggataacctagaagaaatgaatacattcctagaatctgccaagactgattcaagaagaaaaagaaaatccgaacagacaaataacaggtaaggaaactgaatcagtaataaataaatttcctatcaaaggaaagcccagggccagacgactttgctgctgaattctaccaaacatttaaagaactaataccaatatttttaaacctcctccaaaaagttgaagaaggaatactttcatactcatttaatgaggccaacattaatcatcattctattcttgtaggccttgtgtgattttggtaatcatcatcaccagaatcacacaagacctacaagaatagaaaataatggatcagtatctctaatgaaaacagaggcaaaaatcctcaacaaaatactagcaagtggaattcaccagtgcattaaaaggattgttaaatgtgatcaagcaggatttatcccttgtattcctgggttacaaggatggttcaacatacacaaatcaataaatgttttacaacatattaacaaaatgaaggacaaaagccataagatcatcttcttagatgcagaaaaaccatttgacaaaaaacaacatctttttatgatacaaactcagcaaattagccacagaaggaatgtacctccacataataaagtccgtatacaaaagcccacagttaacatcataccccacagtgaaaagatgaaacctttttctctaaaatcagaaataaaacaatgatggccactcttatcatttttactcagcatagtattgaaagttgtagctagaacaattagataaaaatatattaaaaacattgaaataggaaaggaagaagtgaaattacctctgtttgctgatgacatgatcttacatgtataaaaccctgacaattccaccaaaaaaaactgttacaactgataaattaattcagtaaagtttcaggataaaaaatagcacacaaaaatcaatagtgtttctttaatagtgagctgtctgaaaaagaaattaagaaatcaatcctagtcacaatatgtgtcaagaaaacggaagtaaatttaaccaaggagatgaaagatctgtgtgctgaaaactataaaacactgatgaaagaaattgtggacaacatgaatgcaaagttctcttttgcttatggattggaactattaatattattaaaatctccatactatccaaagtgatctacagggtcaatacaatttctgtcagaattctaatgtcatttttttcaaggaaatagaaaatataatcctaaaattcatatggaaccataaaacaccccaaatagtgaaagcaatcttgagcaaaaagaacaaaactggatgcatcacactatctgacttcaaaatctattacaaagttgtagtaatcaaaacagcatggtaccagcataaaaagagatacattggctaatggaacaaaataaacatcctagaaatttacccaccaatttatagtcaattgttttttttgatgaagatgccaagagcacgcaatggagaaaggcaatcttttcaataaatgctgttgggaaaactggttctccacatgcagaagaatgaaattggacccttatctcacatcatatacaaaaatcaattcaatttggattaaagactaaagagaaaggcctgaaactataaaattactagaagaaaacataaaggcaaagttctacgacatttgtctgggcaaagatttcttggatatgaccctaaaagcacaggtaataaaagcaaaaaataaataagattgcatcaatatggcctctgcacagcaaggtaaacaatcagtagaatgaagtggcaatgcacagactgggagaaaatatttgcaaaccatttgtgggataagaggctataatccaaaatttataaagaattcaaacaacccaataacaagaaaacaaattatctaatcaaaaaatggacaagtgacttaaatagatatttctcaaaagaaaacatacaaatggccaacagatatatgaagaatcgctcatcactaatcatcagggaaatgcaaattaaaaccacaatgaaatataacctggtaaaatggctatttttaaaaaaagacagatggtaagaagtgttggcgagggtatggagaaaagggaaatcttgtgcactgttggtgggaatataagttaatacagctattatggaaaactgtatagaggtgcctccgaaagctaatgttagaatgaccatatgatacagaaatcccacttcttggtatagaaccagaggaattggaatcaaggtgcgaaagagatctgtgatctcatgttcattgcagcattattcgcaatagccaagatatggagccaacctacatgtccatcatcagatgaatggataaagagaatgtggtatatatgcacaatggaatactattcagcctttaagaggaaggcagtcctgtcatttgcagcaacatgggtgaatctgaagaacattatgagaagtgcttattgctaggcccagaaagacaaatactgtatgatgtcatccatatgtagaatctaaaagagttgatctcatggaagtagagtagaatgggagttaccagaggcttgagaagggagatagggaatggggagacattcatcaaagggtaccacattttagttagacaggaagaataagctttagtgatctattgcacagaatggtgactataataaataatacactgtgtatttcaaaatggctaaaaaagtagactttaaatattttcaccaccaaaaatatgtagcctggtgatggttttgtgaataagcttgatttcatcattgcagaatgtaaatatatatcataacatcattgtgcaccccataaatatatgcaattatttgtcaattaaaaataaaatataaatacataaataaaagtcaactggtgggaaaaaataggacctgagaaactgattctaagtgttgtttgtaattctgcatcatcccctccacataagctgtatatgaccaggcactctgttccttgtcatatccctagcacctagcataatgcttggcacatggtctgtgctctgtaaatattgagtgaaagaatgttcacttttgggggatgtcgcaaggtgaggtaaaaatgtcatttaacagattttgcaattggtttatcaaattatatttgctagaattctcatgagaagtaaacacatcgtagcacttacacagtaaacttgctagctgagaccatttgatttaatttagtgtacagttttgaattcctgtatcatagctgggtggaaagcacactaaaattagattcagaaaattttgggttcaagccatggtggcatcccttagactgtggaactggacaagtcagtttgcttttctgatactgagttttttcctctgtttaatggagttgataatgacactgacatatacacatgagattatatgtgaaaacacctaaccttgtgcctagcacataataggtattcagcgatgctttcatgtattgccatgagtgagagctaagatatactgatgtttcatattggtcaagatgctttagtttttcttttttcatgaattcaagtcactgtgtgggacataatttaccaatcctaactttgtgtgctcacttttactttaaaaatgtatagtacaactttaactaactcagccacacacacgcccatttccatcaattctattctgtttctcatccactccctcatgtctcatccatttcgtttttttgtattttgtcctatagaaaacattcaaggatagggataactctgtctctaagttagcttgggtttttcattttgtttgttttattttgtgttcaagaatctcgaaataacttcaaatttatatttacaaaatttatattgacactgaagaaacacattagtgttcttcccctaacaggtaatttcacatttgtctcctttttgaagtattatcacacttttctttgggctgcctcactttccacggacttctgaagctcttttaagatgtggttttggagctttttttctctgtaagcatatttcatggttgacaaatatacctcaaggacatgttacaatcagtggtagggaaaaaatagattctgactttgccctcatggaactcacttttttttttttttttcaaattattaccctcaatttaattaacataatgaatgtgatcaaacgcaaatttattgacttagcattcttatcaagtttctttgaaagtgcaatgacgctgaggttgaataaaaatgagatgctggccaagagctgtagtttcaaaatatatactcaagagaactgctgagagagttacagaatatatgatgcatgccagcaggggcggctgtcatatggacatcttcacggtataaccagttcacacatttgaaccttcatgtagccggaagagaatcctgtgtctccactctaggtgtaaccagcatccatgctgcagagtaccttctctgctggaaaaccaacagctaggacaagacaccaaaacaaacaaacagaggaagaccattggaaagttcctgctgtgaactcatctcttctctccttttcagaatgtggtattttccattaaagaaacagaacatactgaaagctgtcagtaaaactgctggttgtgtttttattgatttttctgagcagacttccagtaatagttcattgcatattcatcctgggatgttgtaatatagagcaggattaagaagtaactctctagtatttgggtgtccacggagaagcagccccttgcaagccatgaaaattatatttattctggcttctcctctacctgggggacacagccattcaccatagcacaattgaccttatgaattgtatcctgccttggaggaagaaaggctttgcatttctaattgctttctaattcctttgtaaacatttaagtcagcacaatatcattgtcccatttctgacatgtatcgaatactgattttacgtatcttctgctcctatccggcttttaaggaatgtggaggtagaatgctgtgtccattatctttgcaatcacagttttcagaagagaattattcataggtatgtaatctcaaatgccttgtcaacatctccctggaaagttgaaacaaaaacccacactgataattcttaaagctaaccagttctaccaactcacacaatctgcaatattattttaattaggctctcctatgttggtgatatttctgatacattatttaggtattttacttgctaaattattattttttcataattttagttatcacagtatcaaaaattttctcactcagttccaattctgtttgcagtgcatatctttattttgataaggcaaaatgcagtagcttctttggagttgcagaaagaaaaattagtaggtttttttttttttttttagacagagtttggccctgtcgctcaggctggagtgcaatggcatgatctctgcccactgcaacctccgcctcctggattcaagcgactctccggcctccaagcaactctcccacctcagcctcctgagtagctgggattacaggcacccacgatcgtgcccagctaatttttgtatttttgtagagatggggtttcaccatgttggccaggctggttttgaactcctgacctcaagtaatctgccctcctcggcctcccaaagtgctgggattacaggcatgagccaccaggcctggctattagtttgtttttaacttttacgttcttctaggttgttgtggatgttttgtttgttgtttcttatgttataatagtgatattcaacacgtcttgaggtcagcaaaaataataaaataaaaatttctttctcttatgataaagtggcttgtattactttctttttggaatttttaaaatcctagaaaaatactatgtcaggtaaagccgacaatcctttgttggaatagatacgttgtctcttctagctacataaggaccaggtgatcctgcctctctcttcttcacctcagggcatgaaaaatcaggaaatatgaatctctactattagagtgtattagaggatgaaccaccagggacacggaggtagaattattttaatcatactggcaatgccctttattaccctggaaattgattttcgcaagaaatgtgtgaacaccttttgattatcagattgcttggtggtgcattgggaagggagggaaaaaaagccaaatcgggtgaaagggctatagtcaaagagaaatatatatatatatattatttttatttatttatattctgggctgtagtcaaagagaaatatgtttttttactttttgaaatagatttatttatactacattatgctgaggccttattgatttgctacatttagcatgttagggtttagtttcctaaagacagatgacttaatcatacaaattactcctccttgcaagagggatacgttcagagatcaaaggcaagtcggtagtgtgcctaacagaagcagagtgtatcagttatctagggccacaatattgctgcataacaagtcaccccaaaactcagtggcttgttatgtggcactctcgtgaccgtaaatggcaagggtttggccgttaattggggcatgagtcattagtcatctagtcttccagaggttggggctttattctgtggattttatactcttgttaatattcttatctcttggctaatctggatccaggagctatgaaaaacattcttgagaccagccactgagacttcatttggaaatggggaacagtacccatgaatagatacactctaccactcaaaataaccagattatgtatagtctgcaaatgacttgccttttctggttaatgaagggttaattgaatgtgaggtttctgtggatttgaattccagctcttaacagtcagccgtgtccacttggacaggcaattcatcctctcagccttaacttgctcctatgtgaaatgggaactttgatttacaagattagaattgagtataatgccctatgtggacgtgctttggaaacttttaaagcactagaaatgagttattttattgaagtcaggctgtatgccgaagaatgttcaaatccagcctttatggccatattctcaggctttatcctgctttacacagcaaaattggtagatatctttgtaagtttgtttgcttaaatatgagtataatgttatcttcaatttaacacatgctgtatttagtgtatcaaaccaaaaacatattatagatacagagaacttaaaagatacaaatgtctggggcttttatgaatgggaaaagtcatagttataatcagaatcaatttccaattatccacatatagattaatcaaatgggcacatacccaaggcaactccactttttatctttttcctgacagtattttttcctctgcttatcttttagttttctcctttaaattgtggcttggtgggacaaaaggaaaagccttttaaacatgctaaattacccttgtttttctcaccctgcctgcctcagggaaggttcaaggagagaagtcacaggtagaaaggctggtgtttgaaataaattgtaggaagtcagctgcccatgaggagaaggaaaggttgcaaaaggaggccatgtcgagggagcctaagttgcttgagttgcttcacatctcttcttgcatcaggcacccatgcatgtttcacctgttattgtaggatctgtaaactttgagagtgtgagcaccaatgatgaatggcaggtgttgagaccacaatggacgaattcagagtacctagtcagtcaccatgtcttgtccctcattttatttgaagaatctggtgttctccctcctcttcatttgcacggatgctgacctctgttgaggtactcatgtctgcaccatgacttgactttatcttctagtttgtgttaaaagacagtaactttcagaaaaagacaaaatcctgacttttatacagatatgaaatgaacaagagttagtaattttttctgttaatacttaccaatccatgagggagccaagcagatgctgtaacaaattctcaaggaaaatccaaaaagcagattcactgataggtcaggaatattgaagtgaatgtacaaattgagtaaaaccagacccccccccccccccacacacacacacacactgcattactgtcatttacctagagcttatggaattgcagcagttgtaaaatactcccttataaccacaatcagataacctggaggggttctctagggtctagacaatgtaccatattatatggaaacacaacgtaacatttttccctgtgactggctggtcacattgcggttgactttgaccaccaccaccaccaaaataaacttgtataaacactgctttcaacatttgactcattcccaccaaatgttccttggctttccatcatagattctacctagtgtaaagtcttcccagtcatctggtcctttggtaatcgcttccattgtcagcatcacatgccgcttctcctcaaaacacaaaccctactccagtcagacgggcttctccactctacatttgcacaattcttccttcagccaagctttacgcagatctctcctttgttgaaaaggttattctgccttattaagcctggtcttttctgatcccctgatgggtgtatcagttgtactgagcaaaccatcacttaattacctgctttcttgcattattggggttcactttgtgtttgctgatttcaatttgattgcaagctctttttttttaatatcccaccctgcctaatagcattatgagcatataaaagccacctgttatatacttcccactctgtaatgatccagtctttggataccatccatttgtgtgattagaacaagaattgaataaatgaggagagacagggaaaattttcatttcttaaagttgttctctaaaattaaaagcacttacctgaatcttaattctaaaacctgcccccaggagatcccaaaacgttggtcatgactctgtcttgactgattgggctctccctgattgctgggtttcattttagaaagaatgtacttaatgggagcagaaaatcatttgatattttatcattaagccccttcagagcaactgttcgagtaactataaaccacaaaattacattttatattgtgtccaaaaacgatagaccagtttggaaagcaaaaagttaacttctctcagtccaaagtgaagtgagttgggaactccatgcaggccaagagagggaaactgaggctgttcctcgggcttgctgggggagaccttccttgaagccccatgcagcccctggggttggcaggtgccataagttctagcttggattacagcaaaggagaggatatgatttttctcttcctttatgaagacagaaatttgtgtctgttttattcgcttctgtctccacatgcctataacagttctggcttattttaagtgctcagtaaatgtttgctttcgaataaacaaatcttgtttttcattctctaatcagtgtaacatctttatagtttctgagtttatagtttttgaaaatcccattttggtggaattcaaatgaaactgttttctctaatcgagaaactcaagaaacccagttgtatgagaaatgtccagtcaagaaaaaaaaagaattaatataattacagccaaaatatgacacgtgtattacatatttacatacatttatatgcctcacatatattttaattgatagaaatctgccttctacctataagtggttacgtttataagtgttctattaggttcttatggcacaggcttttgttgctgtaaattacaactgactaaaatctcacaaaattatttacttattaaatacagctttcataataattgtacatggcacatatagaataatagaagtcatttgagacaaagctttgttttagtgttggagctttttatttaaaaaattcttacttataaaagaaactttcaaatgactcaaagtaaaaatctgcttatgttaattattcttggtccactatcaatatccacagtgagctagctcctgaaatggttattgaataccttttttcctcatgtcaactagaagccaagttgcctccagtagttttcaggccattttttttttcctttctgcttgaaatgaacatttcccaccggtcaaattagacaacagattaccaagtaaatttatttcatgtatgagggcttctggaggagaaagtaaaccaacacataaatctgtcttaaaagcagcaaatattttattgatccccatttgttgaaaaaaaaaagctctctaagccaagtcccatcaaaaataacagttaggtggaaagatccttggtagcagtagaaatggtctttcagctctttagagcagtaaaaacttactatgaaattttattgctaaacaccttagttaaaattaaactatctttaaaacagaatatttaattggagaatttccccctatatccagtattataaagaagtctgaaatttatttggtgcaaacattcatagtatattttattctatgggatttttttttccccaggggcctcaagaagatgatttgtagtttgtactttcctctgggcagttgtaacctttgggtccacatatatgaattatgagaatgccttcacatataaattatgtttattcctgtcattgaatattttggcactataacgttgttaaatcactttagtaaaatttggaaatagagaagtggagggcgtcaactatccaatgtcccctggataggaccagcaatgaaagcctgagccaggacattctgagtgtctgtcagccccagagcccacacatttccctgttcttcagttgagctggggaccaaaggacatcctgacctggatactaggcagctgggacttttctaaagggagatatttagtctaggtctggctttagacaggatgtgaagaatttaggccaatgttataggaagaatgtgttacctaccacaaggcagggagaaagagaattgggagctgaaaaagaatccaagttggactgacaagctggggcacaacagtttgcagactttacaatgaggcagacgtgatgctgactttttatgcatgttacctcattaagtttgttccctgcaacacacttacaccttaggtattgttactttgttatgtaatggtaatggactgttagctttaaaaagtccatggtgtggtggctcatgcccataaccccagcattttgggaggccgaggcaagcagatcgcttgggctctggagttcgagaccagcctgggcaacatggtgaaaccctgtctctactaaaaatacaaaaattagccaggggtggtggcacatgcctgtaatcctagctacttgggaggctgaggcagaagaaccgcttgtaccggggaggcagaggttgcagtgagctgagatcacctcactgcactacagccggggcaacagagtaagaccctgtctcaaaaaattaaaatagaaaagaccataattcacatgataataacaatcagatatcttaggatccaaaagctttttttgcatatttatctgttttagtcgattaaatttttctatttgtttacctttgtgttccttttcttctaataaaattctctggagaatttgcgttaatttcctccatgcagtaggaaaatggaaaggtacagggcttcacacctgaaatagtcatggagtgagactagaattcctacagagcccaggagttatggtgatcattgagagtacatgtagagaatcctaaaagaaattcggaattcagactagattcatatcaccttttcaactggccttcctgcctaagttctgttaagcttttctctttcattgtatgcattgctggcctattatggatagcaaatagctattttcttcatagaaaatattaggagatacataaaaggcatatcatttgaagagcagtgattggcttttaaccatatgattgttcttgttgtttttgttttgtttttgcttggcatatgacctttatgccactcccaagacagtagggtatcatggcttgtttactagaaggcctacagtgacttccatctgagctacccccagagcttgagatgggacactcagtgaccagatggctaatggcaggacaagtatgtgtctgtgggagtcctgtgcaagtctattgcatgtacacaccggtatatacactgtactaggtagagtggccgcagcttcatgggactcttcccaatccaccattatttggcagctaccatgctgtgaactgagagtatactaatcatgtaaacatttgggaagaaagactttttaggaaagaaatattgttaaggacccatgactcaattcagtataatcgaaaacactctccagatgtgtagcgtctgtttcaccacagaacaaggggtttgctgctgcagcagtcctgagcccttgatttaggatgggcagagcactagagctctgctggagaggctatacattttgacagccagagccatctccatggttttcatcagtcatggccctcattttgcattgtgatatgtgagagagaagcggaactaatgaccacacgctctaatgggggattgtacagatacagctgcgggccttttgtatggttggctaagattttagagtctcttgtcttgccccagggattgtgcttctgttgagattcgcagaaagataacctaaagaatcaggagctgtcatttaggaaaagttctacagacaaatgacttattatttggacattttttcatatttttcctctgttataattaacgtttatagaaattttgactgcctgaggttaattatacgtaggtgtgtacatgtagatacaaatgtgtatatataaatacttctatgcatgtgtgtgtatatatgtatatatatcttggtgtgtaaactaaactggttataaaagagttggatgcttctgggaaaaggcagctcagtatcatgacactgtaatgcagcacattttttccagagttatgtgtgttctgtgtcgatgacttttcctgattttacccctctgattgaatttcaaaacagcataaatacagtgagaaagttttttatggtcttctgagtgcaaagaggttaacctctagatttctgagctgtgaaacttgggatagaaatgagaacatgtctcttatatcatcttatactatattaagctcttggttatcaattatctgagctactactaataaattactaggtgacatgcaagttggtaaaatgtatttgggtgcttataattgctcatggtatgtttctaatgttctagaattgccttgcatttcaaataaattcagctacccaccaggattgtcattaccaccccatattatttatttatcattattctagacattctggccaatggagtgtggtataaaacaaagtgaactataaatattagaaagaagataaaccaccctctgtggaaacaaagagggtcagagaaattgaacaagtcatttaccaaagaagaaatacagattgccaacatacatgtgaaaaaaatataatcttactagcaatcaaaaaataacaggataccatttttcatctgtcaaattagcaaagatgataaagtgatgatcatcattattgaaaaacatctggtatgtcgggggagtctcccatgtagctattggaaagaaagatgggaaaattatttctgaaagagaatttaatatatacatcaaaatcttaaagatgcccatagtcatctctaccacagctccacttctaggaatttactatcggcagtgtctcctctcttcttttgcattgctaatccctttgagaatctgatgaaagtgatgaatcctctcttagaaaaatgcaaatatacaatcaagtttgcatttaatttctcaggtcctgtggtgatcgccaaaccccagcaaaatcacagcaccctctattgcaatattgattttgcgtaacacccaaaatactgttactttaaaaactggaaggaatccataaactcgagtctgggaaactttaatacattttacatattaaattagaaaaacaaggcacaaagtaaaattttacatttagaaaagttaaaaaattaagcacatattatcattgtaacatacattactagccgctgctgtctgcccttccttttgacttctaccccaccagagctgcagcctacatggagctgatggaatttcagtcccttcctgccgtggttagtgcccctgagtggagttttaagaaccaaattttgggctggtccttcgctctagccagcaccttccacttgcaaattttgctttttctctttcctctaccaaggagagggatttgtgagagcaaaaataaatgccagcacagaagggaattcaagtcccctttgcaatcgagagaccctccagaggattccctcctcctgggccaagtgcagcattttgttaatgtttttagggagtgagggctgcagtgcagattggcacaatgtggatgggaacaatggggtgatcaagcttggtaggtagtaaaaaaggctgagacagtgctgctttaaagggggttcctgagttaggagaacatctgtgacttaagccaattcagagggattttagaatgaggggaaaatcactagatcctataccatgctgttgtaactgatttattcacacccaacaaactgtctcagagttagaaaataactcttggtatgatgagtagaatgtatcaagaaatcatctgccactctgaggctcaccctaaaaagcaaaatctgtggaagtgacagtatattgtcataaagggacatcttggtttcttcacgtcagcagtcttactatgcagactctcctgcttttctttttttgtgattgcagcatctctggctgagatcttacaccaagatgtagaacagcttcttaaagccaagccattcaaaaacctttgttcaggctcttgggctcagagggagagtgtctgaattcagatcccattttgtttctaagaggtgttgtgagagttgggtaagagctttgattccgaactgcctgtgaatcaccggacaaatgacttaacctctctgttcttcatttcctaaactggtgtataattgggtataacagtccttattttccaaggctactgtgagaatttaatgacttcatacattaggcatataaaacagtgcctaatagcactcaataaatgctaaatgttattattatctttatattttggatgagatccataaaataaatagaagtcctataaattcattataatataactacctggtgacataaaactctctttaacttttattttgtttttattcctttgttttctaattagatcattacttagtgtgatattggcttccagtggattatgtttttgttttgtttcaatcttactgtgggaccaaaagaccatctatacctggctgaactaggctttctgtccagacctttggcctgggtgtaaattccttttgctagcagggtgggggccagatggaaggatcatctcaagggaacctgggcaggagccctttccagggttgattctaactctgcatggttctggaaggccaacggttgacagcagggtctgtatccttggcatgaacattggtgttaccctcatggatgtgatgctgctccgaaatgcatgagcagcggcagacaggactggggaggaagaacatggtggtgttaaatggtgactacaggctttgtggggccatagaggacatttccttggaaacaccctgaattaactgcctattcttttattgggagctattttgcagctatcaagatggtaggagatcttgccacattatttgcatgtacataaactgagagtgattcaatttttataagcacaggctgggggttttgggagattgaaggttcatgtgcagtcaagaacgagtagaccgttggattgcagaacattgagtttaaattgctgggattttctatgcattttgaaagcaagatggtatcgtcaaattgtaatttttgtctaaaccaaaatctaacagcgagatcaagttgtttggagtgactgtttgggttcctctttgaatctagggttctagtctgaagaataaaaacctcacctgtctgcttttggaagctgattgtgggtaggggtgaatttaattcatttagggatagtttttcattatctagggcttaaattatataattttttttttactttttctgaaagaaattaaggtaaactaagaaagaacttaagatttttcaccgtaagatctagccaagtttattaatttttcctctatatacctctccaaaaagaagagctgtttgaggcatgttttaaattttttttaccacaaagtgcgttttttggttccccccctcctgactcacacacacacacacacgcacacacacacacacacacacacacacacacactttcctaatttagggatgctgaagtttcagcatttaccaaaacaaaacaagaaaaccttggaggaaaagatgtttaggaagttagttatatgtgtatgtctgcgtattatttataggactaagctttgctgagaaaatgtagcattctttcatcttgtttatttttttaatacaatctactagttaaagatgaggaaatattgccttattgcagcatggttcccagcagagtcggggggttcgttgatggaatatgtgagacgctgcaaaagccattttttccttcaggccctgattgaattgctaccagccaggggcagaacgatggtggtcagagatgggctatgtcaagtttaatttgggctgtggcacttaaggcaggcagcggaggccttcctgtcacagagtgagcctcagcaattgcaacctattctgtgactgccaaatcaaagcatgttaagtgaccaggcaagggctctctgctcttgacaagacacagcaacagtgactgacagagaaggctgtgggagtggcccagaagggcatgctccgtgacagtgtgctgggcaggcaatgcagcaccttggcttgagacatttgctgttgattgaagtctcctgaaattcatcggtgtgttcacaaaagaaaggtttcctcatcaattcactcccaccccaaactctgttttgttgtatagcccatgcaaggcactgctcactgttactttctgagaatgttcacaagttttgtgcaaagcacttcccaagtaaaataagacatcactgccacctgtgatagcagagccctgaaagcccagaaaccttgaacaaaggaacagaaccatggacacaagtcaagccaccagcagctcctgttcatttgaaccaatcattaaggaaaattaacttaggaaagagcataagtatcaggttggccacattttaggttacatggacatctttattatgtttattaggatatcagtcattcactttattaattgaaattattattaatcaactattatcacttattcaccaatagaccaacatccaaaagaaaaataaactctccacataaaactagcctgaatcgctgggcacagtggcttttggcctgtaatcccaatattttgggaggccaaggcgggtggatcatttgaagtcaggagttggacactagcctggccaacatggcaaaaccccatctctactaaaaatacaaaaattagccgggtgtggtggtgggtgcctgtaatcccagctacttgggaggttgaggcaggagaattgcttgaatctgggaggcagaggttgcagtgaacggagattgtaccattgcactccagcctaggcaacagagtgagactccatctaaaaaaaaaactaccctgaattttaaaatatttaaaaattgtaatacctaatacgtttttatgccattaaaatgttggacgttaaggagaattaatttattttttattcgttagtctttattgggctcaagcagtgtgtggcatgctattactatgactcacatctctacattctaggaatttacactttagcatgggctgttactgtgaattcctagacagtcatacacaaagcaaaatggaggggcctggcaagaagcataaagcagtcctgagtccaaggggcagagcgaggctgtgatggccatttcctcaggaaatgatgagcacaaagacttatcttcattattgtccattgtagaacttggtgttacagggaaatcaagtttgactttccaacttagattcagtatcaaatcactagtgtagagtttgagagctggcaataatggagggacatttggaactgtctctaagataggaaggagagggacatgcagggctgtctctcaactaggatagtgagggagagcatttgtcggggaagcaggggagaggggccaggtggtggtggagtgcaggtcctacctttttcttggtgggatgggcagagaggagctaactcagcaccagctctgtcaatgatccgcctctgtattcctgcaggatatagattgccctttaagtcctggtagatcttctcacacaagcatctcagcatcctcatgcgtcaggtgatgggggaaagcaggaacacccaggtacaccagcccaacagaagggttttgggaaaagcacagtcgaaaaagtcaatatgcaaacagccacatggaaaatccagagtttacaaggacattcatcataaagagacatttcctaaaacaataaaaataaagttctctttaaaaagagatctgctttcctggtttaaatctgtgagtcacggtttctgtatctttgctttacacatacaaggtcctgaaatatggaaggggcccagagaattcagataatcatcttttaaaggacttcaaaggatttgagctggatgtgtccttgctcttccttggctggccacagagccatttcttctaatgtggttcacaggtctgccccgggcattgccaagatgcattttctgcttacctaagccgatggcttccatggctggccaggcatggctctctccttctgaatgaatcagaaggaagcagttctgaatctgtctactagacagtgattgcctgctttgccctgctagtaatgtgctgctgtgtcctaaaataagaaaataagactgctccctggaccactgagaaggtgcttcttgaaaaataatgaaagagcttcatgcttttccttaatccatcatgatttgaaacttttgcaccagtgcaagtacactctcactaaaaataaatgtgcttgctgaagtagccgttcgtctcaaaatatcctgagtccgcttcgctctttattcttgttttccaaacattaaagaagagaaaagcttctttttttttcttctcttaagaatacacttcttggcaatgactttaactagacaccattcaaaattacaatccataagcctctatattatcagtactttcttctgtatttctaaatatttgatatcattctcccttcttaaaaagaaatttctcagctaggcatggtggctcacacctgtaatctcagcactttgggaggccgaggcaggtggatcacctgaggttaggagtttgagatcagcctggccaacatggcaaaacctcgtccctactaaaaatacaaaaattagccgagcttggtggcgagcccctgtaatcacagctactctggaggctgaggcaggagaatcgcttgaacccaggaattggaggtggcagtgatccaagatcgctccactgcacttcagcctgggagacagaacaagactccatctcaaaaaaaaaaaaaatttctccctttctcctctctctctctttctgcgctaccccctttctctctctctctcaaaaaaaattaaaaaaaagaaaaaaatctaataggaaactcctgtaggatttttttcaatgtaataactctaatatggagatgaatagtaacaatattgtcaaattgtcacagtatttccttggatcagctcattaggtaatagcagaaaatctgtggttccaagattatgttaagaatatgaaaatgtaacgggactagtcattaaaaattactttcacatcatgcattgggttctattttgtaaagagaaggtagaatatgacattgaaagcttttgagtggtcacagattttattgccaaaggtactatttttaacctggtgtattttccagttaaatccctggatacactctcctcctcctccctcagccctcttcttgccacacacatgtgtgctccaggacggtcagagtagaatttgtcacatgtcactaaaatagattgatccagccagcatgagagggtggattttgatcacaaacaggtcttttgaatatatcttaaatttactcttcaggatatgaacattgcttagtcaactgtatatgctcatgaaaatcttcatctttttcacttaaattaagatggagccaaggacacgtcttcattgatattccttttagctttttattatgaaataattttaacaaaagaagttgaaaaattattataaaatatttcaatatacataggtttctttttcccatttccccccaatatttatttactttatcatttatattctatatgtatgtgtatatttctatctttttctcttacagacacacaattattgtcttttgaactgtttgatagcaaaatgtagacatgatgtctccgtacttcagagtatggtttctagaaagtaagaggttctcttatccacaggacagttatcaaaatcagaaaattgacatttatacaatactattttataatctagagacattactcatattttcacaattgtaaactattgtactttatatcaaactaaaagtaaatgagtgcccgggaactgatccaggataatgagattggtctcattaatgtcctttaatctggagcagatctttattctttctcagtctttctgacctttatactttggaagtttaagcaatgcccttccatttggatttgttcaacatttccgtaagattgggttcagggggttggcaggggggtaatggaagtaatgttgaattcttcacagtgtatatgactttatcacttagttgtgatggggtgtgttagatttgtccattgagaatttattgctctccatttgtaaataataggtgtcttgtggaggtactttgtttctgtgtaaatatccaatttctcatcagatgtttagtcccaaattttagcatccactgatacttcttgcctgcaacatttattacttcactgggagtcaaacggtgattttctagtctcatcgcctcttttacctttattagtttgtgttctagtataggaacttttctttttcttcctacaatttattcatttatctatttatatcaatattgattcatggattcctacccattctgtgggttgtaatcattactataataatttactttgatggtctaattgtccccagtttggccagcaggagccccttcaagtgcctctgtcgtttgaacatgtttatatcattctttgggcactttcctcctttctggtaaagcgtgatgttccaggaccatgtcactgttttgtgtgacagccctgaaacagctctgtctgagtagggatggcttcttttagtggagaatgatatttagaaaccaagatctgggctttagttacgctcacagtgactggcacattactgctcgcagggtgctaggcacagctaagaagtatatgtatatatgcatgtacacacaaactcacctgtatattgatgtcagtgtctacatatctagatatattgaaagccatggatttggaattactccagttccactctaatgtcccagggttctgtgtagcctccctgctttgcatatttgtaactctctttaacaatgagaaacatggttctcaacatttactatatagctactttttaacttatttctttaatacacatgaagtaagttcagcattgtaagtctatggcactttgataaataaacctactaactaaagtacaatgatggtttatagtttttctgtctttagccagagggaatattgtccaaatactgtgttaaaatgttatttgagcttgttttttcctctcttcactgcagttatgtttttcatttgcaatccagttaggtttactcatttttactttggttatatgttgaatattttctccctgtttctcttgattgtgttaatttttgtatccatgattctgcaagtcacaactatacaaaaaggtatagttaaagaagtatcacttcttcatgccttctacccattcccacatccccattattttaactccattcccaagcaaccactgcatgttggtaatcagtttttttcttctggtttcttttttcacaaacaaatatataaaaatatacactttcacttcccctacttgcttacacaaaacaattttttttactttgtttgtttgtttgtttgtttgtttgttgacgatgtcttgctttgttgcccaggctggggtgcagtgccgcgattttttttgtatttttagtagagatgggctttcaccatgttggccaggctggtctcaaactcctgacctcaggtgatccgccctcctcagcttcccaatgtgctgggattgctggcgtgagccactgtgcccagccttttttttttttttttccacataacaatatacccaataagtcacttcatgtaagtacatatactctttctcactccttttcacacgtggaatagtagattagatggatttactgtaatgtattcaactgctttatttggtatgagcatttagattgttttatgtatcttatgattacaaataatgcaacattggataaactgtgattatgtattttcatattgaagagtaccttcattgtaaattcctaggtatgatattgatgattcaaaagacatatagagttttgttatagaatgatagttcccttccaaaagggttgtactaagttgcattccaaccatcaatatatgagtgtctgtttctctgcagccttgctaacagaacatgggccatacattttacttttcattagtatgtccggtgagagaggtatctcagtgttgttttaatttgcatttctctaattatgtgatactacgagtagatattttaaataagaatccgtcagttaagagataatctagggatttcattcagttttctaccaaatatattaatattctagttaaccgcacatttttaagtatatatcaaatatttttgttctaagtttaaatagttgcaagggatataatttctagcatatgttaaagactgtcattttaaataattttctacatggctcttttagatgtagctaatataatctaaacaccaagctggcatctctttaaaattatcatgaacaagctcttctttaataatcataaattttatcgttgtttttccttgaactttaatagcccttctattttccacacagaatttcaacctaatataagtttatggttcagtcttttatatgttactctgtgagattacacaaagaattggatattcaaataaaaaagctcatctagtaccaaactttactaataattacaaataaccaaataattagaaagcacaagcaaaacagaatgtgagctaggactgtcagtacagcaccctcagtcctttctcgctgcgttatatatggtctggctcaaatcggcacggaagatacctaatactgtatacagtggcgttacttaagtagagggcacccttttaatcttgaaacatctccattttatacttagttacattgtgagattctttcttggaagctatatgccataaatccacagatttcaggtttgtttaccgattctaggcaaacaggtatatcctacaaaaagaattccacaggtaaggatttgcttacttgcaaacagcagaagatgtggtcattaacaagttgacaataagattagactaggttctttctttctctagggttacctccctttctgcctcataaagggagagagtggatttcataactgttgcttaatcatttattgtctaccctgtcatattttctctgcaagaaaaatatataagcaattgaaattttcaaaaattattttctgtaacaatacatctttaagtttaaatatttctttggtttgagttatccttacaattagtattaatatccattgatcagaacaacataaatatatgatacattttgataattataaataaaagtagtccctgcccctaatccctgacaaccagtaatctgttctccagttctaaagttttgttatatcaaaatttatatataaatagaatcatatagtatgtaacctttggaggatgactttgactcagtataattacccccagagattcatccaagttgttccacatatcagagtttattccttcttattgctgagtggtatcccatgatatggatgtaccgcagtttacttaaccatttatctgatgaaagacatctggactgctagtttttggctattgcaaataaagttatgaacattcatgtaaaggtttttatttaaatatgtattcatttctctagaatatataacaattccaggtctaattagcctcagtgtacctctccttcttttgttccaaatctccactggttgcttactagaatctctagacttgtagccagtagatttgtgtgtttgtgacctctaaccacatgctgtctcaacattattctttctaaatgtttagtgccttctgtgatccattcctaatgagttgtgcacgaaggaaaatgaattgataaagtgctacaaggactaaaattggtgacatttttcacctgccacactgtttgtcccttgaatccatttgtcaggatgactcaagcagtgtgcttgatactgatttatcatttagagaattttctcgttgtgaacatgttagggcctagagagctctgctgaatttctgtcgcttttcagcatactcttctgactagaaagcagagggagaggtatcagacctgtcaggaaataaattgttcttgggcctctgggtggaacagctccaggttttatcatcctaagtccagctcaccagaaggggccacatgaggggatgtgtatttcaatgtggtctcgtttttattaagtgactttgtcttcaggggcacacttcagtaccttcaagataaatcgcttctgtctttgacagtgacaatgacaatatttccaagcttcacacatccaagagccaattgacaggacaaattgcacatggggactgcttggtaagtgcaaaatggggcacaaaatctcaagtcaccctgcatcattggaactaagttctaatacaagtggcagaaataaatctgtcactttactacctaattgtgggacacatgccgtatttaacagctgaaggaatgttcacctctttgctagagttcaaaaatagtacttagttattccttgatattgggtcttggtaaatttgctttttcctccgtggtatatatttctataataaaaatagatttcctaataaaatttctattaatatttttatagattatatcgacataatctgtgcaaatacttagggaaaagtgctaagcattttttaaattttctcaatatttttagccttaggaaagttactgaaataaatatctcccaaccaaggcatgtgcatatatgtgccctagagattgtgtactttataaaatcggcatgtttgatactattaaaaaaattaagagtaagtctgtatgcctttctgggtcataatcattccatttagaaaaacaaaccaaaacagactgttaaagtcagaggaaggccttgtttaggcagctaagcttaccctctacttcgtggtcaggcaggttaacctggctaagcagacattaggcagaagacttggaggggtagccccatggtgaatgacaattagtaggcttcatcccagtctagccatgggacagctagatccattttcgggtttttttgttttgttgtgttttgtttttttgagctggagtctagctctgttgcccagaccggagtgcagtggcatgatttcagctcatggccacctccgcctcccaggttcaagcagttctcctgcctcagccttccaagtagatgggtttacaggggcctgccaccacacccagctaatttttgtatttttagtagaggaggagttcactgtgttggccaggctggtctcgaactcctgacatcatgatctgcctgcctcagcctcccaaagtgctaggattacagccgtgagccaccacacctggcctagatctacttttatcctgatgaagtgaagtagatctgccaaaagacagaccccaaaatggtatcagagactcactctgggaacaaatcaaacaaaagaaaaaacctagctttgattcagagtcatatgagcttcctgaggatgacacacagaagcctgtagggctgaggagtaggactctggagccattgcaaccataaaggatgcccaggcctgctctgagctgagaccaagcctcttgggttggccttctgagggtttcaactgcctttattgagggatgtgcacagtcctacccaccatagtgttgggctccaagagcaattttttagcatgtgttgtctagtatgttgatatacaatgcacgagaggcagggtaataaccagcatagcacagatgtaatgtttgctttttggaattattctttgaagtgggaatggtttgctttgttaaacaccatttcagagttctttaggaatatgatgtctgaatattaactatgcacactgtctttttctttcaatgattgatgcattataatctaaaatccttgggctatgcaaacacatctctggttaaggacagtttacctgcctttgacccaaaccaccttgcaggatgtttaaaaagccttggtagggtgcctattgctttttgctgtccctgactaggccttggtctcagtatggacatttgaagaaatggccagagaaaaggtaaatgatataagaatggaaactaaggtgtctgaatcctcttcaagtgaagaaattaaagcagtggaaagagcttttgttttgtggtggaggacttgggttctacatctcacttttccgagaccagctgtgggatttggggcaagtgttctcagatcttttggtatcagaatcattgcatttgcaacaaaggagtggtgttaggttggtgcacacacacacacacacacacacacacacacacatataaatgattggccccatttatatgtatgtgtgtgagtagagggaaggaggggggtggagagggagagagagagagagacagacatatctttaaaataattgactcacatcattgtaggggctggcgagtcccaacattttaagggaaggtgggcagacaggagatccagggaagagacgttgcagtcttgagtcagaaatcagtctagaagcagattttcttcctgcttgggcatctgttctctctactaaggtcttaaccttattggatgagacctacctacattatgaagggtaatctgctttattcgtagtctattgatttaaatgttaatcacatctaaaaaagaataccttcacagcaacatctaggctggtgtttgacctaagagtgggcaccatgccctacccaaatccatgcataaaatcagccatcactgtatctaatgatatgccttattatagaagttagcttaaggagtcacatgctgagatggaaggaacatttttcttagagttgggagacatgggcccaagagctgattctctcactggtgggctctgggactgccactgacttctcagtggaaaatgagtggcctagttttgatcactgggttccaatgtgatcactgacaggtacacattttccatcataggctccatattttgagcaattttatttgcccaataaatcacattatgtaaatgtgagttcattttttgcttatacatatatatatatatatacacaataaaggagacactgtcagaaaacaactttccttggcccttttgaagtattgaaaatagttcccagattaccactcccctttgctattgttatgggtgtctccagggtacaggaagactgatggaggaccctgcaactccttgatggctgatgctgaaactgggcagggagctccaggaggaaccagacaggatcctgttagcaggctcaccacaagtctaaagggaccagccttgagaagggcagttgggatgtggcaaatgtgagccaggtttctgggtcctactgtccaggttcaagttctggccactctgtgaccttgggcaagttacttcaacctcttacaagttccctaatctatagaaacagctagtacataccttatggaattattatgaggattaatgatccatataaagcatttagccaagtacctggcatagagtaagtcctggataaatgttggctgttggttctgttcctgttagtgattcccaggaaccaggaattggttctagtagccccctttgtgtcttccctctgcattcttctagacctccaaaatttattattgtgccgacaataatttcatagatttcactatgaacagcatctatcctttaataccttcttcgtggcttaaagcttgtaatacaggttcatggtcataattatcgagtcagtgtttgtggtttagattgttgggaaattggcatgcagatccatctccactcttcaaagtgcccagtggattctgtgcctctgtggccagcaagaaaggagcagattcaagctgaggtcataaatctctatgttgcaccctttgccttttctctggaatgtgcaggtgggaatccatgtgatggaagaagagcttgactctggtattttgcccagggttaagagcagcttttctttttctcatcttctgccttggagcccaaaggctattaggattcccagcaaagtttcctccattctcttttcctatcatgttattttatgtcagctgggtacatattgtatgtcctacagacaatggaaaaacagtaaaatatttttttaatttttttattatatttcagttctgggatacatgtgcagaacgtgcaggtttattacataggcatacacgtgccatggtggtttgctgcacccatcaacccatcatctacattagatatttctcctaatgctctccctcccctagccccccaccctccaacaggccttggtgtgtgatgttcccctcctggtgtccatgtgttctcattgttcaactcccacttatgaatgagagcatgcagtgtttggttttctgttcttgtgttagtcacagcaaagtcttttatatctcaagagagacctctagaaggtctttattcttggcttgtcattcttgagaagcccagcagtaagtggaacccaagctaagcttgtgaagctgggctcatccagcttggaaagtcgaagaactccaggaaagcaggtgcttgggttcttgcacaatcatccatcccatcttccatctttgtttgggaacccttgacgttacccttttgatcccactctccagtctagcgtgaggtgagtcaggttcaaaacagcagcttctcaggccagaatgaaatagcgaccggccaccaggggaaacaaatggtactgctcaaccagaaggataaatgtcgggcaaccaagtttgttttgccacagatgagcagggaatggtgattcatgaatgcagagctggctggggtgttggaaaactcatgagttggaaggagagattctgaggacactgctctctcctgatccgacgctgttaacactgcagacactctggcgggtcccttggcttcacagcctctctatattttcacagtctgtgaatattctcaaataacttcttcagttggggttgggcaggtccatttacacacactgcaaatgtctgtgtttgggagatcagtttatgccatggaatgacacatggggaaagtgttcattttatttctctcagaatgattcattggtaataagtttcatgcccaatgcctgtttctgcaaccatagaaaagatgctggtatttaccgcaatttccagctagttgttacttttcctgaagacccctcttgtcatcttccaagtccctttgttccagcaccctgggtggtgaaggctcaaagaaaaatctgtgtatcattttggacacattttgtgaccaattttataagttggtgttttctgtctactttgtggctctggaaggttgcgactcttaaagacagggcctattattcctctagaaagtattcacctctttcatagacaggataacaggattctccttaaccaaacctgacattggtgcacagctatgttagttgcggaacctccagaagcagccttgcacattgagttctgtgttcttactcataaggaggatgtgctcacagaagaatattaaagggaattttcccacatgagagaaaccatggcaggaggggacctctctatttatatttagagtgagtccctgtaacagtgttgatatagaaatatacaggtataatggcccatatacagggccataaacagggtttctgtttattgagatgggggaactccatggcccaaatacacagggggcatggttgcatgcagagcataactgaatcattggtattttgagacaattaatttttttaagtttttactcaatttcccttgaaaatcagagccataagatgcatttctattaaaccgtatacaaaaaaataaagagggaagttcactttttgaaaaaaggtctgaatagtgtttttcagtgacttacagtcaacattatgggttaatgccaaactctggagaatttaatgggagaattaagaagtatgtggacaggcagtaagtaattgacttcctagagcaaagtgcacagacataggtcaggattccggaacttgggccattatggataacagcagggctgattgaaaagagtttctgaggggagacggtcttgctacgtcattttatccctttgcattccatttttagggacacgctatttaaagaattctttccattccatttctaggaaaccccattcagataattgttttcctatgtttctcttttcctttcttttcttttcctttctttccttttctttccttttcttttcttttttgagacaaggtcacactctgtttcccaggctggagtgcagtggtgcaatcatagccctctgcaacctccgcctccttcaggttcaagcagttctcctgctcagcctcctgagtagctgggactacaggcgtgcaccaccacacccagctaatttttgtatttttcgtagagatgggtttcaccatgttggccaggctggtcttgaactcctgacctcaagtgatccacccactttggcttcccaaagtgctgggattacaggcctgagccaccacgcccagcccctatatttctttaagaagtgccaacttgttaacaatatttcttttttttttttttttttgagacagagtctcgttatgctgcccaggttggagtgcagtagcacgatctcagctcactgcaacctctgcctcccaggttcaagcgattcttctgcctcagcctccccagtagctgggactacaggtgtctgccaccacacccggctaatttttgtatttttagaagagatggggtttcaccatattggccaggctggtctcaaactcctgaccttgtgatctgcccaccttggcctcccaaagtgctgggattataggtgtgagccactgcacccggccattaacagtatttctttgaatttatataatctcatatagataatatatttcgaatttatataatctcatataagctacacatctgtgctccactcatctctccagtacacctccaaaatacaaccttatttctttcaaaatctttattttataggtaatacatatttataaagatttataaagaggaagatattttctcttagttaccaaaattttgctactatgaaatcggttttcattggagtgaatcgtctacaactttcaataaagttttttagaagtatttttaaattatgtcatgatatatatttctgtatgcaatttttagaaaaatatcagagagagagaaagtgtgcctttagagcaaatcaggattttttctaccaaacataaaaacagttatttctagtttcagtgaatagtaaaaataaatatacctcatttcaggcactaaagttaatttcctccgtatgcttttttccctaatttatttttattttggtaaaatacatacaacataaaacttaccatcttaaccatttttaagtgcacagttcagtgatattaaatacattcataatgtacacaactatcaccaccaaccatctccagaactgtcttcatcttgcaaagctgaaactctgcacccattgaacagtaactcctcattcgtccctcccccaatcccccggcaaccacaattctaattggtctgtttctatgatgttaactactctaaatacttcatacaaatagaatcatacagtacttgtctttttgtggctggtgtattttacttagcataatgtcatcagaattcatccatgttgtagtatctgtcagaatttgcttcctttttaaggctgaataatattccagtatacattatacatatatactgtattttgtttattcattcatctatcaacggacacttggatttcttctactttttagctattgtaaatagtgctgctataaacatgtgtacaatatctctttgatatacatctttcaattatttggggtatatacccagaagtggaactacagagtcatatagtaattctacttttaattgtttttttttttttttgagacggagtgtcactctgtcacccaggctggagtgcagtgatgtgatctcagctcactgcaacctctgcctcccggtttcaagcgattctcctgcctcagccttctgagtaggtgggattacaggtgcacaccatcatgcctggctaatttctgtatttttagtagagacggagtttcatcatgttaatcaggctggtctcgaactcctgacctcgtgttccgcccgcctctccttccaaagtgctgggattacaagcgtgagccactgcgcccggcctctactttgaattttttggagaaccgccacgctgttttctacatggtatagaaattgtactgttttaaattcccaccgacaggatacatgaattccaatttttcttcatccttgccaacacttgttattttctgcttttttgatagccgccatcctaacaggtgcgaagtggtatttaactgtagttttggtttgcatttttctaaggatggtagcatgttttcatgtttttttttttttttggcttcaaaaaatatctattaatttccattgcccattttttttttccccagggattgacatacaggaactttatttttttaaagctttttttcaacttttaggtccaggggtacaagtgcaggtttgttacatgggtaaattgcgtgttgccgaggtttggtgtgttaatggtcccgttgcccaggtagtgagcatgatgcttggtaggtagttttcaaccctcacccccgcaaccctccccctcctggtggtccccagtgtctgttgttcccatctttatgtccatgtgttctcaatgtttactcctacttataagtgagtaagcaagtggtaggagtagtcagaggggttcttgtgttgtgataagtgtatataaattgagtgagccgcttattagtagaactgataatagccacttattagtagaactgataataggataataggatgatggctagggtaacttcgtatgaaattgtttgggcaacagctcataatacgctcattagcgcatagtttggattggatgctgagaacatgtggcatttggttttctgttcctgaattcacttcagacagtggcctccagctatgtccatgttgtcgcaaaggacgtgattttgttcttttcatggctgcgtagtatttatacatggtgtatatgtaccacattttctttattcagtccactgtggatgcctttgcccatttttaagttgggttttttgactttttgttgttgacttttaggtgttctgtatgtattccagatattaattacttattacatatatgacttgcaaatattttctcccattggatgggctgcctttttaaatatgttgacattttctatttatgcacaatttatttggtgcgtaaacaccacaatttatttgctgccaaacgatcacagattgtccacatgagtggctgagatagtgacacgtttgctttctgatggctcaatttacacgaactttgatgcataaagtgattaaaaatattgggtaaaactaatggctatgtgtataaggtatatatgaatcataatcataaataaatttcagttcaaacttaggttatctccccaagatatctcattatgtatatgcaagtattccaacatctgaaaatagctgacatttgaaatacttctggtcccaagcattttatctaagggatactcaccctgtattgttagtttttgtcctgcaatattattccctctgcctcctcctgtcctttcccactgcctctgttcctaatccaggccacccttgcccgctggctgtgtctctgctatcagtcaggcctccccatccacctttcttcctggcatcaggaaagtctgagttcacaggctctatcacatccaggcactccttggaccttggcccttcagtggcattccagaggagcaacgacgccccgattcctcagaccacatgtggggcgatcctgcaaaggtcagcctatttttatccagaggtcgtggacctcttacacggcttctgctccagggctgtcttaggctaccgctttacgtgtgctcaggttagcacagcctctttgtccaagctgattgagactttctctactacttgcctttactgtttccctcctcctttttagcaccttgacttgctgggctcctatgtagtctgaggccaatgttttgaaatccaatgcctcttcctgaggccttctgtcatcagtatgccactgcctcctccactgaacactcacagtactttgctgttccccttcctgccctttccacggcctgccttacatcagagtcatagctgtgcaggtgccaagggtgagagttttgtcctggtgaactgtggagctaggatttaaacctcaacttcacctgcctcaaagactgtgctctgaatgagtattcaattatttctttcccgtggatattcggccctccccagtttcatagcaatccccatgcctatgtgttatattgccattgtgtataagaggttcccaataaatacttctggaatgtatcacacttacacatctttattaaaaagttattttcttaaagggactactcttgtcacaaagatacaatagtccttaacttctgtgttttaattttttatatgtggcctgtattgtcccactaaatataaccattgtttggaatcattctgaccaaatgtcccctctcagttctcacggtttccacggaccctcttctggtctttctctcctcgcattcgtagtatttctatttgtgtcactaattttaaatgtaagtatatactatttcatattatttcttagatgatctcttaagttttatgcctttccataatgcctatgccccaataatagtaattctgtgcattttgtggaatgaataaaacaatgaaaggatgaaaatcccttcttggcatattataaacacgcttttaaaaagacagtatttgaatcgtttggaattatttttcttagttttcatactgcctacctagctaggtgataagccagcattctactcttgattcttctgtagatctttcatttattatcagatcaacagatgctcatcagttcaaaaacagtttaggttaaaaaagaactgggcactgctgttatttttaaaaattatcttgggaaggaaaactatcatgctttaggccataatttcaagagaacagtttttgcgtccttggcattagaagcaggcagcctaagtgaaatcaaacattgagagatttggaaagagacccaggctaggagataagtttaataaagattttgtttttccaactcagtgtccttttgattccttcctattattcaattctgtgtgtgtttggccgaaaataaactttgagtgactttatgatgttaaaggaatgccaaattatgtaaaagatcatactcttcgttttaattggggtttaaaaaaggagtaaggagagggagagtagttctctagaaattagattttaaaatccaactctattcaaataatttcaatacatttgccaagtaggcaactcattagagagaaaaggtagaaattttgatgagttattctttcagggagcaagaaagaagtgtcttcaccttcccaatgtgacaccatgactgtgtggaacagctactcattcagtctatcagaacaaagagccttctgctgatgcctcccttttcttcctctcttgcatctgcaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcat

SEQ ID NO: 38494 - DNA, 16015 bp, Homo sapiens
tttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacagggtaaagggagtgggtggggggcctctgtccagggagggcggctcgggtcgaggaccagggtccggactgggagcaatgacggggagcctgcctgacctctcgctggccacaactatgccctgcaccttgcgtgggatgtgcgccacgtctgtctctgtaattccccctggcaggtctgggacccccctgagactccgtcagaagattcggtcctccccataggtggctttacctctaagcatcccgccctcttttcccccatcgcccgccctttttgagcccgaaagcttgcagccaacttccaactccctgtcctgtcctaggtaacccctccaccccgccattctcctatcccgtgtctgtccccatccctgtgacccctgacccctggcctttgccactccccagggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggtaagagagacattcggttggggcgtgtccagaggtggggcttaggagagagacgcgggggtatcgacaggggtcagagaaatggcgtggactgaacttcatttctttgtgagaaatgaaattctaccttctatccttgggaaaaagaaattaagttaaaattgaggcctaaagaggacctttgagaccgggcgtggtggctcatgcctgtaatcccagcactttgggaggccaaggcaggccgatcacttgaggtcaggagttcgagaacagcctggccaacatggtgaaatcccgtctctactaaaaatacaaaattaggcaggcgtggtggtgggcacctgtaatcccagctactcgggaggctgaggcaggagaatcgcttgaacctgggaggtggaggttgcagtgagccaaaattgcaccactgccctccagtcagggcgacaaagtgagactccgtctaaaaaacaacaacaacaataaaaaagaggacctttgagggcagcaaaatctgggttagattctgccccctaagcgctccttattcttttgtcccagacatctcccctccccaagcctcagtttcctgctctgtaaatggcagggactggtgtggaaaatgaggtttggcctttaaggagcccggccagtgcaggagagtggcagagccctgagtttcagggtgagctgggtggaatggagccctgtccaccctctccgtccaggcctgagcgcaggggggcgcgatgggagcagccgccttcttctgtgcatcctcctgacactgattgagcctgcaaaggtttatcgagcacctgctatgtgccaggcactgctctaggtgctgaagtcacaacagctaacacatctgtcctcctgaagtttacactgtggtgagggaaacagcaagaagtcaataagtagaaagtggatcaaatagagataaatgcatccaagaaagataaagcaagagagtcagaaagtgtggaggggagaggttgttggtgggggggagttgcaatttttatttatttatttatttatttatttacttattgagatggagtctcgctctgtcacccaggctggagtgcagtggtgcgatctcggctcactgcaacctccacctcctgggctcaagcaattgtcctgtctcagcctcccaagtagctgggattacaggcgctagccaccacgcccagctaattttgtatttttattttttatttttatttttgttgttgttgtttttgagatggagtctcgctctgtcacccaggctggagtgcagtgacgtgatctcggctcagtggaacctccgcctcccgggttcaaccagttgttctgcctcgtactccctagtagctagagtcctagctacaagtgaacgctacaagtcctagctacaagtgaacgcctccacatccagcaaagttttttttctttccttttttttttttggagacagagtgagactctgtctcccgggctagagtgcagtggcgtgatctcagctcatgcaacctctgcctcccaggttcaagcaattctcctgcctcagccttccgagtagctgggactatgggtgcacgcccacacgcccagctaatttttttttttttttttgtattttagtagagatggggtttcactgtgttgcccaggctggtctcgagctcctgagctcaggcaatccgcccgccttggcctcccaaagtgctggaattaatgcgtgagccacagcacccagcccaggcccaggtaatttttcttttttttcttttttttttttttttgagacggagttttgctcttgttgcccaggctggagtgcagtggcgcaatctcggctcaccacaacctccgcctcctgggttcaagtgattctcctgcctcagccttccgagtagctgggattacaggcatgcaccaccatgcccggctaattttgtatttttagtagagatggggtttctccatgttggtcaggctggtatcgacctcctgacctcaggtgatctgcccacctcggcctcccgaagtgctgggattataggcatgagccaccgcacccggctggagctgcaattttaaacagggaacttggacaaggcctccatgagaaggtggtatgtggtatttgagccatgtgggtatcggagtgaatagcattccaggcagacagaacagttaagtgcaaaggccctgaggcaggagtgggcttggagtgtcagagcaacagttctgaggcccgtgtggctggaactcagtgagaaaggggagagagtgggaggtgagggcagagaaggagcaaaggggttcagcatggtggttcatgtgtgtgatcccagcactttgggaggccaaggctgggggatcacttgagcccaggagttcaagaccagcctgggcaacatagtgataccccgcctctacaaaacaaatacaaaaattagcccagcatggtggcgtgctcctgtagtcccagatactagggaggctgaggagggaggatcacttgggcctgggaggtcaaggctgcagtgagccaaaatcatgccgctgcactccagcctaagcaacagagcaagactttgtctcaaaaagagagagggccaggtgcagtggctcacgcctgcaatcccagcactttgggagtccaaagcgggcggattgcctgagaccatgcaaagggggtcagatcatgcaatgcaaagccttttaggccacgatgaagatttaggcttttctccaattgagagtagaactgagggagggcatgagctgacttaggttttgagagaatcctgctggctgcgaggtggggaacagactgtagggagcaagaagcagggagcccagtgaggaagcgactgcgatagtccaggtggaagacaagacaagatggtggtcagatcagggtggagacagtggcagtggtccccaggactgctggctgggagattgtgcttggatgggcatgcatgaaggagaaatggaggaagaagggcagtgacaggttagcacatttagcttagcactaatggcaatgccaggcattgtcctaagtgctttattattgttattattattattattttgagacgcagtctcgctctgtctcccagtctggagtgcagtggcgtgatctcggctcactgcaagctccacctcccgggttcatgccattctcctgcctcagcctcccgagtagctgggactacaggcgcccaccaccacgcccagctaatttttttgtatttttagtagagacggggtttcgccgtgttagccaggatggtctagatctgctgacctcgtgatccacccacctcggcctcccaaagcactgggattacaggcgtgagccatggcgcctggcctttttttttttttttttttttttgagacagagtctcactctgtcatccaggctggagtgcaacggcgcgatctcggctcactgcaagctgcgcctcccaggttcacgccattctcctgcctcagcctcccgagtagctgggactacaggcacctgccaccacgcccggctaattttttgtatttttagtagagacggggtttcaccatgttagccaggatggtctcgatctcctgaccttgtgatccgccctcctcggcctccaaagtgttttttgtttgtttgtttgtttttgagacaaggtcttactctgttgcccaggctggagtgcagtggcacgatctcggctcactgcaacctacgcctcctgggttcaagcaattctcctgcctcagcctcccgagtagtggatattacaggcatccaccactgtgcccggctactttttgtatttttagtagagacggtttcaccatgttggccaggctggtctggaactcctcacctcaggtgatctgcccacttcggcctcccaaagtgctgggattacaggcgtgagccaccgtgcccggcctattattgttattattatttgagacggagtctcgctctgttgcccaggctggagtgcagtggtactatctcggctcactgcaacctccacctcccagattcaaccaattctcccgcgtcagcctccagagtagctgggatttcaggtgcgtgccaccatgccctgctaatttttgtatttttagtagagacaaggtttcaccatgtggaccaggctggtctggaacgtctgatctcaagtgattcgcctgtcttggcttcccaaagtgctgggattacaggcgtgagccaccgcgcctgtcctgtcctaagtgctttacatggcctaactcatttattccccacaaccgcccttttggggtaggtaccgttttttcttcctccgttttacagaggggtaactgagacacagagaggttaagtcacttgcccacagtcacacagccagtaagaggaagtggctggatttggacctaaaatgtctggctgtggagcccaagcgcttaacaacaccaggaacctcagagaagggtgtgattccggggacagagtggggccctagacagactggagcagagaccgcctggtgcgggaggtggggcggtgactcaggcaggcctggagagggctctgctgtctcggattttcgactttagggagggggccgcgggggcctagggacggtgacagggaggagggctccaggtagtctctgttaattagagattgggagaggaccggcctggcaaggcgtcaccaagggagaggagaggggcccgagagctgataggcgtggcccaagagaaggggagagatggaacctaaagtggcttgacatgcgacagggaggggcacaggagcccggaggagcatggggaggggcagagggagactgagcccccggggttgcgggtgatggtcctcaggcagtgcctgattcagccgggagcaggcaggggaaagccacggggctcagcacagggcagggctggagggagaggagcctgaaattgacacgcgcagcctggtaagggggaggggcatggggcgggtcggggcctgagacagcgggggatcgggggtgtggccgtggctgtctgggttcagagtcaatcttgcaacagggcccccttggcaagggtcacagtgcgacgccgcgctccccttcaccaccccagctcggcccagcgagaggtgcagcacgtgcaggccgagggcggggccggcgcggagagggtggccctgcatcgtagtaggtccctcccccgcagtgctcccagcaggcccgctcgttctggagaagggcgtgactcgacctgggggtggaccctaggctgaggggtagggtcctccggtgggcttggtcccgaaattgacccgcgcccctccccagttagcccgcggaccgtggactgtattttcagccccggatccgaagtgtcccagggggcgtggcccgtgcgaggggcggggcctgggggcgggaccagagcctgacgtgtgcccgccccggcttctaggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtacgcggcgagcccccgaccctgctccccatacaccgtgaccctgaccttctggaccgcctcattctgagaaccctgaacccatttacccggagtccctggcccctaaccaggctctacccacttttaggagcccataactgtgagatcttcagtttctcacctctggcttctcttttttgtttttcgtctgcttatttttctggtatttagctgcatgctaaaaacgatctttttttcaaacatgaagtcacaattaggtgctaaaagccactgaacgcacccaaacagggacttgaaacctgggccctcaaattaaaagtccaatgctctaccaactaagctacccaggttcccttcagggctttcattctgggactcaccacctctgtgacaatatgactagggtacttgagatccctggccaaggacacctactttccatgccttgtcatcctgacccctaacttctgtgacctctcatcctgagaaccccaaagccagttactcagcccctgactctcagatccctcctttctgtcccaagtcccagcctcagtgccccacaccctgccacacacacagccctcattctctccctcctctcctctctgtccctggccccagcctccccgtccagtctgtcctccacagggctccgggggcggggttcttcatgcccagcactgactctgcccctccctccccctcctgggcccccaggagacggtcccactccccagccgggacgtttcctcctgtggctttgtttttctgcattttctgcaccaaatggattttctgtggttttcctgaactcaccacactcttcaaacctctaccttctgcccatattgttccctccagttacaatgcccgtcccctcctctcagtcaagccatctcagtccctgtaagctaccccatcacagccttagtctggggccaaaaggcccactgtcaactcatagtgggccattcctgtctccacacgcttggatcagttatttcttctctctgagaatcaatttttgcattcagaaagtagaatacatggaaaaacccactgtatgtgcttttttgtgatgattaaatgcaatattgtgcataaagagcttagcatataatctctcacaagttagctaatttattgggtggatataatatgttacatagcctgggtgccatggctcacgcctgtaatcccagcactttgggaggccgaggtgggtggatcacgtgagatcagaagttagagaccagcctggccaatgtggcaaaaccccgtcttaccacaaaaaaatacttagctgggcgtgatggtgtgcacctgtgatcacagctactctggagggtgaggcaagagaatcacttgaacccaggaggcagaagttgcagtgagccgagatcacatcactgcactctggccttggcgacagagtgagactctgtctcaaaaaaaaaaaaatatatatatatatagatagatagatagatagatagatatagatatacacacacatactaataatatgttatataacatattatatacttaaatatatatacaaattatatataaagtatcaatatatgcttttttttttttgtgagggagttttgctcttgttgcccaggctggagtgcagtggcgtggtctcggctcactgcaacctccgcctcccgggttcaagcgattttcctgcctcagcctcccaagtagctgggattacaggcatgcgccaccacgcctggctaattttgtatttttagtagagatggggtttctccatgttggtcaggctggtctcgaactcccaacctcaggtgatctgcccacctcggcctcccaaagtgctgtgattacaggtttgagccaccgcacccggcctacttttttttttttttttttttttttgagatggaatggagtttcactcttgttggccaggctgcagtgcaatggcaaggtctcggcttactacaacctcatcctcctgggttcaagcaattctcctgcctcagcctcacgagtagctaggactacaggcgcccaccaccatgccaggcaaatttttgtatttttagtagagaaggagtttcaccatgttgaccaggctggtctcgaactcctgacctcaggcgatccacccacctcggcctcccaaagtgctgggattacaggtgtgagccactgtgccaggcttctaaaatttttttttttttttttttgagacatagcctccctctgtcgcccaggctggaaagcagtggtgcagtctcagctcacggcaacctccgcttcctgggttcaatcgactcttgtgcctcagactcccgagtagctgggattacaggcgtgccccaccatgcccggctaagtatttttttggtagagatggggtttcgccatgttggccaggctggtctcaaactcctgacctcaagtgatctgccagcttcagcctcccaaagtgctgctattacaggcgtgagccactgcatccagcctactgatatatacttattaactccacagaaatctttgtaccccagtaggatttactttgtctttgttttaacctgcttggcgtttcctccattaaagctcatctcactgagacctgtccttccccaggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgtgagtggcggctggggaaccctgtcccccacacccttccggggacccaggcttccggttcaggtcctgcttcccagcaccgacctgggggcaggcagtcacctggttctccagcatcttgccggggaagccaggccgcaaacacaggtcagaggacggtgacctttcccacctccactctcagtcccctggggtctgatctctcctcgtctggccttcccctccctgtgctcgcatttggggtccaggcccccagccttccctcagacagccactgtgccccaccttatacaatttcttttctttcttttttttttttgagacatagtctccctcggttgcccaggctggaaagcagtggtgcgatctcagctcactgcaacctccgcctcccgggttcaagcaattctcctgcctcagcgtcccgagtagctgggattacaggggcgcaccaccacacctggctaatttttagtagagacagggtttcttcatgttggttaggctggtctcaaacttttgacctcaggtgatccgcccgcctcagcctcccaaagtgctaggattataggcatgagccaccgtgcccggccaatttttaatttttttttctagtagagatgggatttcaccatgttggccaggctggtcttgaactccggacctcaggtgatctgcccaccttggcctcccaaagtgctgggattacaggcatgagccaccgtgcctggccccaaaatgtgctttgttctatagaagaaggctttttttttctttccttcctcttttttttttttagtttttgagacagggcctaactctgttacccagaccggagggcagtggctcaatctcagctcactgcaacctcaaactcttgggctcaagtaatcctcccacctccgccttctgagaagctgaggccaccaggcacaagccaccatgtctggctaatgtttttttttttttttttttcagacggagtctcgctctgtcgcccatgctggagtgcagtgatgcgatctcggctcactgcaagctctgcctcccgggttcactccattcttctgcctcagcctcccgagtggctgggactacaggcgcatgccgccatgcccggctaatttttttttttttttttttagtagagacggggtttcactgtgttagccaggatggtctcgatctcctgacctcgtgatccacccacctcggccttccaaagtgctgggattacagttgtgagccaccacgcccggccatgcctggctaatttttaaattttgtgtagagacagggtctcgccatgttgcccaggctagtctcaaaatcctgggctcaatcgatcctcccgcctcggcctcccaaagtgctgggattacaggtgtgagccaccgtgcccagcccacagtcttatagtgaatgagtttggatataaattggggaacaaaagtcgttttgctccagaagggcacaaaaacaaggagcggaggtgtccagtgtgtcagaagaagccccaaagtgcaccatgttcacacataaagcagaggtaggttctaggctctgctaaacataaaggagcttctccccttggagggtgtttgctggggcttgagcaagttattagggacccaggacagctccccttgtgagcaacaaacctgtgcactgctggacattagggcctctgggctctggccccgtaaatgcaggtggtgcctgtttgatgataacatcccagaaagcccgcaaatttcccacatgccacctgttgagactgctctactgcctgcctcccacagctgcccggagctaaatttccaagagaacctctcactcttaccccaggggtccagcctcccccaggagccagggtcatcggcccccagcctcaatgcccctttctcctccaggaaaccctggaggacctggacagaaacaaagatggctatgtccaggtggaggagtacatcggtgagtgggccccaatttcttcttgggatgcctgtcctctctcaggcatgggcagggttggtgggggtagccggaggtacatcacccatcatcagagaacagtggccctcagacatgggggcaggggcactcactgcttgagttcatttagccacccaacatttattgagcacctactctataccagacacaaaaagcatctattgagcacctgctgtgtgtcacgcccaggatacacttactgagcacctactgcatatgggtggttgcgcctacagcagacaataacacagacaaatcccttcttgggggtctggagtttctacaaaatcaaggctcaggggctatgtttagttgagaatgggggtcaggaagctggtcttgaacctgcgcctgcacagcaaacactgtttcctgttacatgggatgttgggggatcctcacaataccccctgagttctgagttctccctgggcccctgccactgtccctgcccctagcgggcaaaaaatttagtcaaggagaacgctaacaaggaattttttttttttttttttttttttgagacagtttttttctgttgctcaggctggagcgcggtggcgtggtatcggctctctgcaacctccgcctcccgggctcaagagattcttctgcctcagcctcctgagtagctgggattactggtgcctgccaccacgcctggctaatttttgtatttttagtggagatgggatttcaccatgttggccaggctggtctagaactcccaacctcaggtgatctgctcatcttggcctcccaaagtggtgggattacaggcgtgagcaaccacgcccggccaggaatttttttttaagtttgaaaacattgtttattcttttatttttttctgaccacatcctacatgagaaaacatttttctttctttccttctctcactttctttctttctgtcactctttctttctatctgtctgtctgtgtgtgtgtgtgtctctctctttattaaatagagatgggttctcactatattgtccaggctggtctagaactcctgggctcaagcaatcttcccaccttggcctcccaaagagctgagattacaggcatgaatcaccacacctggctgagagaacatttttatatttttttcttaagagatggggttgggccaggcgcagtggctcatacctgtaatcccagcactttgggaggctgagatggatggatcatgaagtcaggagttcgagaccagcctggccaagatggtgtactaaaaatacaaaaattagccgggcctgttggcaggagcctgtaatcccagttactctggggactgaggcaagagaatctctggaacccgggaggcaaaggttgcagtgagctgtaatcgcgccattgcacttcagtctgggcaacaagagcgaaactccatcttaaaaaaaaaaaaaaaagatggggtcttgccctgtcgcccaggctggagtgcagtggggtgatcttggctcactgcagccttgacctcctgggctcaagggatcctcccacctcagcctcccaagtagctgagactccaggcacagtgcggcctctggagatacttctggttgtcacttctagaggggtgaggatgctactgacgtctcctggatagagcccagagatgctccttagcattctccggtgcacaggacaggccctgacaacaaggaggtcacaggccccagatgccagcagctgtccccatctctttttttttttttttgagacagagtctcgctattgtcgcccaggctggagtgcagtggcatgatctcggctcactgcaacctccgcctcccaggttcaagcaattctcttgtttcagcctcctgagtaggtgggattatgggcgtgcactaccacgcctggctaattttgtatttttagtagagacggggtttcaccattttggtcaggctggtcttgaactcttgacctcaggttatccacctgcctcggcctcccaaagtgctgggattacaggcgcgaaccaccgcacccagcctatcttctcaattacttcatcccattaagacttcatcttccattcctcagctctaccaggcagacactgtcactatcctccattatatagatgacacctgaggcccaggggggttgaagggatctgctgaagacaatgggaagaggcagggctaggatttgaaccttggtgtttgggctctggcacctatttcttaactcctccccaaccagtaacatatcaaaatgtataaaattggggtgggtgccatggctcacgcctgtattcccagcactttaggaggccaaggtgggtggatcacttgaggtcaagagttcaagaccagcctggccaacatgatgaaaccctgtctctactaaaactagaaaaattagctgggcgtggtggcgggtacctgtaatcccagctacttgggaggctgaggcaggagaatcacttgaacccagaaggtgcaggttgcagtgagctgagattgtgtcactgcactccagcctgtaatcccagcactttgggagactgaggcaggtggatcatggggtcaggagtttgagagcagcctggccaagatggtgaaaccccgcctctactaaaaatataaaaattagctgggtgtggtggcacgcacctgtaatcccagctacttgggaggctgaggcaggagaatcgcttgaacctgggaggcagaggttgcagtgagctgagattgcgccattgcactacagcctgggcaacaagagcgaaactccatcttaaaaaaaaaaagggggtggggtcttgccctgttgcccaggctggagtgcagtggggtaatcacagcgagactccatctcaaaaaaaaaaaaaaaaatttgtagaaacagggtcttgctatgttgcccaggttggtcttgaatcttggcctcaaatgaccctcctgcctgggtctcccaaagtgttggattacagtcatcactgcacctggcatctctgtcacctgctaactggccagaaacatcctcgcacgttcctcctgcatagacattgcttactatgtgccaggcactgccttgcccattgcacacactacttcacgtgtgtgtcaatgaaatcaatcaatcatgcaatcaaccaatcaaatgaatttcacctgtaacacaaatgattgcttataagtcaggttttgttactaattccatcgaaacagaagaggacgctgaggcgagagagagggtagtgagttgctcaagggcctggttcaggaagtatcagagccaggatcagcccccagctccactagacccccagagctgcccctgaccttgtcccctctgtcccggcccccagcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggtgcagtgacggggcctcggcaggagcgaggagcgggtgggcattgcgggccagactccagaaaggagcaagacctgggcctggagctcagggtcccttttaggtgggataaaaaaagagggacagagagagggaggaaaagagagggcacggagccccagaaagagagggggacagagacccagagacccaaagagagaaggacagggaccaagacggggacagattcagagagaaagggacagaggcccagagaacaagggtcccagagacttcgggacacgcttggatgcagggagggcttttgaaagcagggccgtgttgtcccctctgaaccctgaccctccctccaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggg

SEQ ID NO: 38495 - DNA, 12960 bp, Homo sapiens
gaggtcacaagctctggtgccccaaaatggctctggtcctcagatatagttggttgccaccctgggagtgagaggaaccaggaaagcaggtgagccttgtatgacacccccccttctaccaatacattgcctgagaatagttgtgctcttgctctgacacccccttgactccatttagagccttacccacctatttgatcattcttgtcttggccacttacgttttcttcacatttttagctggagtgggctgagcccatagctcagtctctgctaataaacgggttggtggtaggttagggcacatatgtggggacaggacagatctgtgtctaacctagcgtgtgtgatcttgagcaagtcattatttctgattttcactttcttaatccataagatgggggaaaatcacaccaaacccatggcaagcaatgcattagtctatgaatatccaaggcctgggaggcagctcaacacacagcagggaccagatgttacatgatcttaactgatgttacaagaggcagatgattgcctttaattgggagctttgaatctgacattgtgtgtgtactgtcatggatgtacatgctgaaaatttcctcctaatttaacctataatccgggacatcagcgtaaaccaccaactaaaaaatttacaattgtatatttaaagaggtcacaagcaagtttaactgaaggtttaaaatcagcggtcccctttgcttccagataaaagtccaaactagcgtttattaagcacctgctaagtgccacatcttcagatacaagtagggtcagagaagggaagcgacttgcccagcgtcactcaggtagaaactgtcccaggcaagctgggcacggtggctcacgcctgtaatcccagcactctgggaggccgaggtgggcggatcacgaggtcaggagttcgagaccagcctggccagcatggtgaaaccctgtctctactaaaaatacaaaaaattggccgggcatactgacgcgcacctgtagtcccagctacttgggaggctgaggcaggagaactgcttgaacccagttcaagcaggcggaagttgcagcgagccgcggtcatgccactgcactccagcctgggtgccagagagagactccgtctcaaaaaaaagaaaaaaaagactgtcccaggcaagacacgaacccgagtccaccagactccagaagcggctcttgcaccagtgcgccgtcccaggagccaaggcccgaagtcagaagtgtaaactccctcacagctacgcaccgcattgttaacgacccagatgaggccccctctctccaaccctgtttccccatctgcactatggagaatggtaccggccaggtctccaggcggttgcagtcgaaacaccccgttccgatccccacctcccatgcatacctgcctgaaaggctgccccacccacccaccagccggagaagctgccccgaactggacgcccggacgtgcgtggcccgtcgcgcgctccctcggacgccccgcttccggggtcggcgcctttaagaaaaggctcgggcggacgccgtagcccagcttcagtgttcctatcgctggtgggttcctcccaggagacccctgcggatgggtggggaggctgtgaattccactccctctacgctcgcaggcctgcatacaggaaagtgcggggatgtgtgtggggttgacccttgggggcccggacctgccggtcttccttaaaatcacagcagggatttggctccagcccaaggggattgctccgagctggcgtttaggaaccaggccgggaggtgtgtgggcggagcccagtagcctgccggaaagggggcgtgtcaccagagggcccgggtgttccggcggggaccagatgtccgggggcgtggtctatcttagcctgggggccgggtggagctgtgcatgggcgggttccagtgttgaaggctggtccaactttggggtccagtcccagtgtcgtgaccctaccgaggtcagtggcccgagcccaccagggggtcggccgactggcggccagaccccaggggccgctcttttaccgattcgaatcttgactctattggcaactcctccaggtgttgggacctctggacctcagttgcgccttctataaaatactcggcagcgtctcgcaaagtgtgtcttgtcaacatctccccaccagaaagtactgttaactagaacactgttaactactttttttttctttttttctttttttttttttttttttttgagacggagttttgctcttgttgcgcaggctgaagtacaatggcgcgatctctgctcactgcaacctcggcctccgggttcaagccattctcctgcctcagcctcccaagtagctgggattacaggcgtgagccaacacgaccggctaattctgtatttttaatagagacagggtttcaccatgttggtcaggctggtctcgaactcctgacttcaggtgatccatcgcctcggcctctcaaagtgctgggattacaggagtgagccaccacgcccggccttaaactgctattaaacatgctgtttccctgcctccttcccagaccgggagacacaggggcgtttgcatttgtaccaggctacccggtgactcccataaactactttgaaaaccggcggatcaggagtatctgagggctccttccctgagctgatcatgccgtggatggaagctattgtgagggtatatgtagacttgcctgggtcggggtgcccaataataaatccaccccactctcaacttctgtagacgaagattccccatcttcgtctagaaccctcacaccagaggacccgtctgagtagaaagccaaggttcaggaagggaaaagcagtttcttcaaggtcacaaagtcagccagagttcagtgcaggcccaaggactcccagtccagtgctctccccaagtctcctctgtacatccatccgcgttttgggggcttgagtctgtcctggcacgggtagctggcaggggtcccgagttctggcccggaagggcctggccacccactgtcctccgcccaacttcggcgcaggccacggggtgagggtagtctctaaaaactgcgaccaggttctaggctccctctgggggtggagccagacccgagcgacaagcgaacggtccaattctgggcgggctctaggcccgacagccaatcggaggccgggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagtaagtgctgaggtcactgctcctgtgcaagaagggaggcatcacagggtcgcggaggcgggcatggggattggggcagggaggactgagagacctggtggagaacagcatgcgggttctcgaaggtcgcggtgccgaccccttttaccccggtttccttcccttcccctttggaccctgaggcaggcctggaaagtggtcagtagggcctcttctctcctttgggaggcgatgttaacagagccccagggcacgagttaagggtttggcccaaggtcacgcccgggatcagttgcaaagccaagaaaagaacccgggacttcctatgtgcccagatgtgcccagcctagctggagggagaaggcaaagagggatgagcctttctaccccataaccctctgccagccttgccccttcctcagggaccatcagaggtgtttacacatctcacacacgcccatgcatctgcacagggaggcaaccccactaatgcccatgaaccagcacagggggatgtatgcacccacgagctaggtatccctcctctccctaggccgtcccatctgcagcttggctggcacctcttcccaccccaccttaaccagggccctctgcactgggcaaatctctcaccctctgcttccaggggaggagggtaaaggaagagaaggcacccacactgggagctccattcctgcctcgcctttctccttgaccctagcagcccctctattgttggtgggtggggagggcagtccaatgtccccgagagcctgcggagaagccccgccagagaaccagagcctctctctccttcttgtcttctggtctttccacatcagcctccacccacactccaagcatagtctggaccatacagtggactgggtccaggggctcccttggctcccctttgtgactgggttggccatggggagaaaatctaacatgtagtggatgcttactgtggatgggggttgtgctgagctaagtctttcttcgacacctgtttgttctgccatttctgtaaccccatgaccctgtggggatgttctcaatatccccaccttagactcaggaaaacggagacacagagaggtggagtgactttctagggatcactagttaagcagctgagctaggtttcaaagacaggcctgtctgactcttgggcaagtgtttccctccaggaaaggaaaaagctgtggtattttttcccccaagcaggatgagggatgtgggaggcagggaatgaggaggtggatatggggaggtgggggatatggggacgcaggttgaggggagtttttgatcaggggagggagactttttctttcaaacatccccgctgcctttcatatcttccaggtttgatcactatgatcatctcacccacagacagaggatgcagggcttcatttttgttcccaaaaacaggggcaccgtagatacgtaaagtatgtgtcctaatgtctcctgaacttaccctcattcttgccctcaaacctttacctccccagtgctttcagaacctagagagacttcatctcactactgagcccctgtccttagcctcatgtttcttattctttcctttctagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggtgagagctggggtaggctgggggaggataatcagtgtttagatttatagagaacctaatcaatcagaagacaatctggttgttgttattgttgtttttgagacagagtcttgctctgtcatgcaggctggagtgcaatggcttgatctcagctcactgcaacctccacctctggggcttaatcgagtctcctgcctcagcctcccaagtagctgggattacaggtgtgagctgccacgcccggctaatttttgtatttttagtagagatggggtttcgctatgttagccaggctggtcttgaactcctggcctcaagtgatctgcccccgttggcctcccaaagtgctgggattacagacatgagcctctgtgcccgccaacaatctattaatgagagtgcagtcctcctctcctgcagagatttgtccactggggcccagagaccagagaggctacgcttccaactggaaacaacagaaaaggttcttgggaatacatggtgtcttgagctgggtcatgaaggccacatagtagtcaaggagttccaagtggagagtcctgatgggcaaaagtttggaggcagacagagggttctgtgagcagccagcaggacagttagggcagtggatgtggggttgcaatagaagaaaaggcttaaaggtggttgatgtggaccgtgggctgcagagtctgggtaagatgatctgtgcatgggaggctgttggcagtgaacattcatttattcacttggcaattatttactgagtacctgccctggaccaggcctttggaacccaatagaggctgggaagacaaggtcctgccctgtggttcttacagggagtgggaaacagataaaaaccaagggttccaagggaagcctgcagggactgacttggggactcaagcaggaaagcaggaatgctttccagactaggtggttaggaacagctgaggagcaaaattagagctgagacctcaaagtggaagcctggcctccgtgtcatgagaaggggtggaggtggcagccatcaggaaggaagggggctggggagagggctgcaggtatccttcagtagtgagtgtgatgcctcttgatctggtgtcagtccctaaggatatgggctgtccccctaagatgatacatggacactcagaatgtcactgagggaccactggagatcgtgcaggctgagactagggaggatggggtgcccctgaggttccccagtatgcctggcaatggtaggattctgcccactgctcctcgcaggctctgatggctggccttgggcttaggagcatgttgctctgacaagtagggctgtggatggcccatcatggcctggttggagctgctgttaaaccagggttgccatatgggccccacaggctccagattgctgccagggagcaactgccagccagcaagcaggcccagggtgcagcacaggcagaatgaggccagggcctgagaggtctcctgggtggaggtaaggcaggatgccagtgttttcccttggcacccatgcagtgggtaagcagatggaggcacccttaagggcagaatggggcctagaaactgccctcgttactttcagtgaaaggttttgtccttggaacttgagaacgctctcttactctttgttctagaggaacattcagaaggcctgggtggatgcccctcttgccaaaatcagaggtaggaagctcgtaggacaaaggcagcggagggcagaagatagctcctggggaccggagacaggcccagaggtgctcactgagtgctgcttcctctccccgatgccagcctcaagcagggccgtgggtacaaggaggagcaaatctgcaccaggctttctgccttacccaggaaggaaaagtgcttggtacaggcagaccaggatcagtggtgggggaggttcctggaggagagggggctgcacctgctggacagtgaggggtagggaagatttggaaaggaaggtgtgggggtggctgttagctgaggaagaggggaaaaggcatggaaattgcgtaaaggttctggccttttctgtagatccttctgaatcccagggtctcaggggagggaggagggcttggggcaagggctgagaggtggggaccacaggggctggggctggggctggatccacttgctcagggtggcaggggctaggccagaagaccccagagttcctgtcacagcctacccacaggagagcaagggagcacccctacatgcaaccctggacaggaggggagagtgaggattgataccctagtttcttttcaggttttgggggtcctgcaggaggagctctgggccaggctggaaatcaaaccagattcaagctgtgaatggggcacaaagaatgtgggaggatttggggtaaaccacagggctgtgctttccccgaggcagaggtagtcatgctcctggtagtcagaaactgccagtttagggaagagcaggatgatggcagaagtccctggattccccgcccaaggtggtcccccaagtcttacccacttcctccctctcctcagggcattgtacagggtttcttactctggcctagaggtcctagatgttttctcaggctgcctaggccctcatcttcaaggttgtacaatgggggaccggacctaggggccttcttaggttcctcttgcatcagagtttttgggagttgacctgggctgatgcctaggggctccagtcccccacccctaccttagtccactgggggccgtcagcctcccataggaactccggagaccaccagctcagggccttgcctagagccactgctctacacgctacagagtctggccactgcctgtctctggttctttttacatgttgtagagacggggtgtcagtatgttgcccaggctggacttgaactcctgggctcaagagatcctcctgcctcagcctcttgagtaactgggactacaggcatgtgctaccttaccgggtccctttactttttgcctgcatgtggctttgagcctgggaagagttgaggggagggaatgtgctgaagttttccctttcttcttcagccctggggagccacaggcaggtgctgagtggctggagctacagttagtattggcagcccagccaataggtggggcccaccagtccccaggccgggcctaactgtgtgggctcccaggctggagggagcctcttgagtccccagactcagtctgggcactgtctgcagctaacaatgtcaaaaggaggcatggggccagtgtggtggctcacgcctgtaatcccagcactttgggaggccgaggcgggtggatcacaaggtcaggagttcaagaccagcctggccaacatggtaaaaccccatctctactaaaaatacaaaaattagccgggtgtggtggtgcacacctgtaatcctagctactcaggaggcttaggcaggagaatcacttgaaccttggaggcgaaggttgcagtgagccgagattgtgccactgcactccagcctgggtgacagagcaagactctgtctcaaaaaaaaaaaaagaggcatgaaggtgaagggggagtggtgtatgtgtcattaggacggggacccacgggtctcttgttcatcagcctcagcatgtccccatccagaagggctgctgggttcctcagggcctcctctccttgccatttgatgctgctccttctcttgcaggttttgtacatcaggaagaagaagaggtaattccccacccaaacccaaatcccacccaaaacttgaggccatggggagtgctgggctgggctccgaaggaagtgggtgaaaagctgatcagggagtcaaggcctgtcctgcccattcatggttgggggtgaccactttcctttggggagggttgagggccccccttgcacaaggatctcacacacagggcaggcaggtgtgaggattctagataactgggtataatcctgggactggggatggcagggagggggaaggctgggattactcccacccaactgcccagccacccttgccctgctgctctgagctgactgctactggctccccagtcccacctgagactcagacgctgtggattacagcaaggccctagcctaggtgatctctgtggggcccatggatgacagctacttggcgtatggccttaccctggagtgggtaactgctgcctccctggctacccatttaaggggttgagctggtactataggtgcaaaaatgtctgtcattttttcccatttcaagggaaaccttaaggccctaagcatggttgtgtgctgtggctcagctagtcaggaggcagggcctggagggctgctgggaggggaagggcctgccctgtccccagcagcctttgcccccatccccaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaaggtgggcactgaccaggctccccaccccgcctgcagcatcctctgtcctccaccctcaccctccctcctttctcatgcagctttctagcacctgccttgtggtcagatggcaggtattgggtatacggctttttccagatttgttcagaaagtggtcatattgctctggggccacccacaaactcacagcgcaaggccaggccaaggcagtcctgggatacagcctggctctgccccatagcctgctgatcttgggagccccactggcatctctgagcctcagtgttctcttccacaattgaaaatcctaattcttgccccatgtgcccccacgtactggttaggaaagtaggaaaggactaatgggagagactgttggcggctaggaccccaggttcctctgcttcctgagggtccgtggtcctgagtgggttgtggatggggttagactcttggacagcggtacctctgagtaggctggtggattcccagtggctgacagacccaggcatgtgaagatctcagccaaacttgcctcctgtgtccaaagggataggtacctgtgtggccatcctgttgtaaccactgggctgcctgaccacttgccaccatttccccaaatccccaagggccagagcaccatgagcaggcctggcctgcccctgacttatccagcctctttgcgtcttcttgggctcagaaagaatccaggctggaagtctgaagaccctttggttttgccaccagctctgcatcacctgggtcaagatatattgcccccttgggatattcaggaactcgcactgagaaccttggtccacccagccactgggacttctggccacttgatacttgtttcccatgttcctccttgtaccagcccctgtgctagggcctggggatacagagtccagccctctgatcccccactgggaaaaggcagtgcatgcataattaaatcaacacagtaagtgcctccaaggtgacagggcaagctggggaggagtcatctgagccaagtcatatttgtaggctgagcttgcagggagggcattccaggcagaagccattgctagtgccaagcataagcaggcaccaggaagtgagggtggaggtgaccaggccagtgagtgcatggccttgcccatggtctctgatgcccctgcctgtcttcctgcagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttt

SEQ ID NO: 38496 - DNA, 3546 bp, Homo sapiens
ccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtgaggagatagtcccgaccctcagcccccgtgggccgagccttgttgggtggtaatactggggtctcagcgaacctgggagccgggaggagaggaagtgcgggaactgagttgggggtggtgccgggtctaggggcgagaacgggatctttggaagagcatccgtgacccctgtagtccgatcgtaggtggagcccccagaaccatgtgccgagcccgctgcttttggagacacgcttcacatacactacacggtgaggggtctggggggccggggcggggcctgggagggggcggcgccctgctgaaacacgtcagctttggcttggacacgtggcaagcggttcgggagaagaaactcggggctctggggtcgtcgagcacgtggcgaggggagagacgttgctcttccgtgcctcttttccctccttgcttttctgccagttcctacctggcacggagaagtgcagggtggagagatctccgagaagcgccagccttctggggcttcctgttccttacagcggtaaggggaacgctaggctgccgcactaagggggctgccgccgcccagcggtccaggtgtgtgttgcgcgcctgctgggagggagagggtgctagatgtatgctcttgatgctctctccccccagggaagcttggtagatggacgtattattgacacctccctgaccagagaccctctggttatagaacttggccaaaagcaggtgattccaggtatgtgacctgtgcctcccattccacctcttcccaacctaagccctttcttagcctcttcggctccaaagctgccctggaaatcccccctgaaatgagtaagaccctagggctctacgagttacctcctgaggttcaaacctcacttctagtactccacttgtcccatatcctattggaagccagagatttaagaagtgagggaaaggtcaattgaggatggaggaggaagactttgatcttcatgtcatgggatttggggaaggtggatagcttccagttcagttgtgtcttcttcttcaaggtctggagcagagtcttctcgacatgtgtgtggggtgagtatctcggcaggggtgggcctgggtaccccctttgcatgggtagaggctttctcggccatcctcactccttaagcaggagaatgtggaataaaggaccctgcttcccactggacaggtccaggtcagtgggacctctgagggcattcaaagcctctgtgcctcttgcgctgttgcttttgtcgggggagttgaggcacatggggagatggacacctttgctggccagcctgtttggtgttcaggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccaggtaatctgactaggactctctctcaggccatcaaaatacccagtccctaagagctataaggagctatatactttgtttgatgcttgagaagatccagaccaagtttgtttagacagataggagtggctggggcctccatctacagggccacctttttcctcctcatatcaccaacagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattctttttttttttttgagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggccaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccctgcaaagactctatccgtgtggttatttggaaatacgataaattagtagttagtatagagggttctcccacttacaaatggagaagagcctgtacatttcatattcacagaaagttttcctgcattcaaagacttgtcactggacccaagccacatgtgtagttggggtcaacatgattatcactggactctgctcgtaaatcctcctctactcttgtctaaaggaattcaagcccacatttaaatcttgtcagcttcatagttgttggctttgctgtggcctacgctccctattttcattcagattctgagccctggataaaatgcagagagtctaaccctctccacccctctgcctctccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactt

SEQ ID NO: 38497 - DNA, 3546 bp, Homo sapiens; identical to SEQ ID NO: 38496

SEQ ID NO: 38498 - DNA, 8660 bp, Homo sapiens
tttcagttctgcttgctgtcggcaccgctgcgttacccggaaccgccgggccgaacagcatgacgtccgctttggagaactacatcaaccgtatcctcaagctggccgccgcgggcgtgagccggggtcgcggagaggccgcggtcggggatcggtgggaggttgggaggcctggcctcggcgggatcctgggggcgggcgaggagatgagggccccggaacgacccagagttcgccggcggcgcctcgagccttcccgctgctgcgggcccaggggtcctttccattttgcctgcaaaacccaaataaaaacccagtgtgattattccgaacttttctgtcttaaaaaaaatgtacgctcttgattcttacttactatttccctatggcataagtgttaaagtttgtgaataagatgaacagtcgtcctggcggcgacaacagttttgcaaatctttgtacttgttttattcacataatttgctcgttcgaggatagcaaaaagtttaacgatggttcacagactgtttctgtccctttaccacttgaagtcccaacttgttggtagaatgaaaaaaaatggttgctgttgtaatggattatagtgaggagcaagtaacaaccccatgggaagtcttaaaatagactttacaagtgttaccgttttaaagtcttaggacaaaaacactacgttaagctcaggtacaaactgggtgacaaaaattaaataccgaatgcttttaatgatgcgttattggtaccctgtgacactgcttatatagtttctttacttttgaattacagaagcctgtcctggaagacagttttttaacatgctggaaaatcgtccaacatcgattaatttagtactcatccacttttcattttagaaataaacaggcctaagaaacgaaatatcctgcctgaaataatagattggtaaccttcctagtagaaaagtgtcaaaaatccaggatattttgagataagatacaccgatcacatacagaaagaggttttctttttctattttttcccttttttaatcatgtaattatcacaaagacaaaaacagaagctttttttaagtttttttttttttttctttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtctaagaaacttttaacgtttttatgtagtgaacttagtggctgtgttgaatacttatacctagttgtcatatttattctaaaaattcaaatcattcccttgccagagtctgttttcaatttgcattccctaagaaacactttctttgattcagttatcaggaactgttgccgttattacatcagatgggagaatgattgtggtaagtctttggaattttcattctctgctttcctgtaggtttattggttgcaagttttatgtgaaacctctaatctctaatgcctagacagcacattacacccgtagtgcaattttattataattcagctctttatcactttgctgtcaatccatgttttcctcactaataaacattgtgtgttacctacaaggtttctcggagctagaataatagattctgccctcagagagctcctagtctgtagacctttattaaacttacttttcttcttccatttttatttccttccccattcagcaccacatgaatcagaatttttttgaaattttgcatatgcttagtaactttttaatgatttagatactattaatatctagataacatttaaggcttgtatacaatcttaatattctttgtttttaggttgtgtgacatgtcttctgtaggacacattatgatgattgactctctatatatacacatatatatgtaaaattggcttgttccttgaagttgtttctcccttgctaatttatgtcatataactaagataaaacgttcctatagtgatacttgtatttggaatttgatctgaggaattcatctcaagatttttgggtacttggttatttcttcacttacaattcatactttgaatgctttcaaaagaattttaaggctactgaactttctctattttctaaccttacctagtttctttaaataatttgatcccttatttttccattcttcagttttgcttttgttcattttctttttaagccttgtgattttttttcactgggtccttagtgactattattagtcaaagttctagctttgtcctttactaaatttatatcatgtgccaggtgcatatatgttacattatttaatgtacagtaaaaacttatgaagaataagtacccctgtattctagattaggaaacaagttcagagaaggtgactcactttctcagagtcacaagggtagcaagtgacagaaccaaactgggatttaaatttggtttgacatcaaagccaaggccagttgcctggcttctttcttaaggaagcaatgatgtttgcttaggcacctcacattgtattttttcaaatatggacagtttgacatattttaatttcaacacttcaggaagcctattgctgttaatagatatttgcatttttttttaatttggtgaaaaccttaagtttaaattttcttatttttgttgacagggtagataataaactgagaaattatttttaattttaaagaagaatgaaagtgatataaaaagcatcttaagttctaaagttcagtagttctgtatttctttgacacataatttatttgatgggataatgtgtaaaatgaagtcaagaagttatgaatggatgtttatgataacaaccatttgctaactagttcaataaatactccatattttgtttctcttccaagttacagatttcattctcattttatttcattctcttttttatttcattctcattttatatattttgactttcagaagataaaacagtttaagaacttgagaggtttaaccatcaaaaccaatgttagttgatatttcttcagaaacttgaataccatgtgagttactctgttatgctagacccatgtcttcttttattcaatactaagctttcataaaactctccctgattatttccttcaagttctggttttaattagtatagtcacatttgtatctaccttactgggagaattaaacaataaatccatatgatacacattaaacaatacatgtgagacacacagaacactggtaactagtatgtactcattaggtgttacatgtaactactagttaaatttttagtatatttatgggactgatttgaatctgaaaaatggcaaattatatttacttgtgtataatagtatagaatgttatggtttagtggtctggctcaggagctagccttttgtggttcatctcctggctctgccacttactacccatgtgatcataagacacaccattctgtgcctcagtttcttctttgaaatggggctaattatagtactaaatcaaagggtagagatgagttgagaaaatgtgtacagtgtgtttagcacactgcctagtgctggcatatagcatatagtgatactattacattgctgtagttggtatgtatggttcttccttatttatgtatatttggctatcattttcccttaaatatcctttgtcttagtttatacctttagctgctggtctacataagcttttatgctacttacttggagatagtcacattagtacataggtgtcctttgcaactgctgtcaactctacatatgagtgagatgtgtggtgcaggtccccccaccccagccaaataaccaagaggtaaattgtgtaccctcgaatactgttggttataaaaaaggcattttatttgccgtcgtataggtacttgtattggaatacctggcaactaaaatgactgtgaggttaaatttacactttcaggtaaaccagaatatttctctttttctcctgaatattttctttacagggaacactgaaaggttttgaccagaccattaatttgattttggatgaaagccatgaacgagtattcagctcttcacagggggtagaacaagtggtactaggattatacattgtaagaggtgacaacgtgtaagtaaaatatatctgttaaaattataaatgatactgccttactttatggagaagaggctttccccaaaataccctactgtattgtccatacatagttaatagaatcttgcattcatttctttcgtaaatataccttttcttatgtttgtgtaaaataaggcatatgtatacattttatgtcagcacttctttaggtttcaaccaaagctgtctctctacaaattaaacttttacctgagatttgcccatttttctactagttaagtagcctgggtagagtccagaaagggctctgccttatattaaatacttcattagagagacttcttaaaacgttctttcaaatacccagaattttagaggaacatatttctagagtccaaggccaaagtttgaaaaatgttttgaaatctctgatttgaacaatattaattcatgctcaataacataggtgtatttataaataagtacttactcgttattcattttcttttaattttttagtatcattgacacacttaagatgtccctgtggcctcagtttacttgggacagacagatataaaagttcaagagtaattggccaggcatggtgcctgtaatcccagcactttgggagtctgaggcaagtggatcaggtcaggagttcaagaccggcctcgccaacatggcaaaacactgtctctactaaaaatacaaaaattagccaggcttggtggcgtgcgcctgtagttccagctacttgggaggctgaggtgggagaatcacttgaacccaggaggtagaggttgcagtgagccgagatcaccctactgcactccagcctgggtgacagattgagacaccaattcaaaaaaaaaaaggccgggcacagtggttcaagcatgtaatcccagcactttgggaggtggaggcgggtggatcacttgaggtcaggagttcgagaccaacttggccaatgtggtgaaaccgcgtctttactaaaaatataaaaattagccaggcgtggtggcgcaagcctgtaatcccagctactcgggaggctgagtcaggagaattcgcctgggaggtggaagttgcagtgagccgagatcgcagcactgcattccagcctgggcaacaagagcaaaactccgtgtcaaaaaataaaaaagaaaagtggctaatgtggttcacgtgccgtggctcatgcctataatctcagcactttgagaggccaaggtgggtggatcacctgagcccaggagttcaagaccagcctggccagcatagtgaaaccccgtctctccttaaaatagaaaaattagcctggtgtggtggtgcatgcctgtaatcccagctacttgggaggctgaggcagaagaatttcttgaacctggtagatggaggttgcagtgagccaaggttgcgcctttgcactccagcctgggcaaaaagagtgaaactccatcttgaaaaaaaaaagaaaagtggctgatgtgacagaggaactgaattttaaattttatttaattgtaattaattttaatagttacatgtggccagtattagtatagttatagaggctagaagaatgccaaatcagttttctagtgagtactacactgaatcaaaatatagttggaaagaagcaaaagatacattagcaattttaagctagaacatttaacaaattctaggggactaactgtcccctggaataacttaaaaagtgcaggaataatttactcatttaagttgtttatgttagcatcacctttagatgaataaataatttgatctgtaatcaaaaatcaagagtttataaaatattttagagatgacttttaggtggagttacaaggtgagctgtaagtaatgagagagagacagagcagatagggcccaggtctctggatcagaacaacactgtttatattggagctgtgcatagtaattgattttaaggtttctcctacttaaaacaatttttttttcttgaacttcagtgaaaaaagtcttgtgctagagccagcttctactggcccatgaaagcatattgttatattttaaggaattttacaagctggttaattgatgtcttgttagtagcttgaaattggccgtggtgggagtgtttgcacaatggatattagtaaatgcagcaaatcagtctcccgctttttttccagagagctggtttttaaaaatgtatcagcatttccctgcttaccatagggattttaaatgatactgaatattatcatttaaaatttaagaatatttaagagtggaattgaggcctttagtttgagaaaacttaattcattctgccagagtttcatatttttcatttattagatgatttaagactttatatactttaaagcaaaatttggcaaatcccttattactagtattcgtctttagaatttggccgggcacagtggctcacacctgtagtcccagcactttgggaggctgaggctggcgaattaccagaggtcagaggttcgagacctgcctagccaacgtggtgaaaccctgtctctactaaaaatacaaaaattagccgggtgtggtggcatgcgcctgtaatcccagctactcgggaggctgaagcatgagaatcgcttgaacctggtaagtagaggttggagtgagtcaagatcgtgccactgcactccagcctgtgcaacaagagcgaaactctatctcaaaaaaaaaaaaaaagaatttactctcattaaaaccaaacaaatgtaaacccaaccaatactttttaaaaataatatttcatagacatcttgtggtctgagtgataacattgaatatttccagttagagggctatgggttggttatctagcgtggtattaatgaatttaaagttatagatactatgttagtgttgaacaagaaaaaattttctagcttttaacctgagccaatcacgtcaaaaatgatttgttagataccaaagtacttgttcctactattatttttgtatatgaagaactggctttggatttaactgaaaacttaggaaaacaatctaatcgctgttgtctatatcattgatttaattcatcaaagttactcaaatgattgatatttttacttgctaattattttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattg

SEQ ID NO: 38499 - DNA, 66391 bp, Homo sapiens
atacaaaaagggcaggcctcctgcgccctccttcccaccccccttcctgccctgggcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtatttctccacattttcgtctaaatgcaaggaatggggcaagaagtttgtggtagaggtttgggcggggaggggggtggaggtaagtaaataagtgctcttgtttgcccacttgtgagtctggacccgaggcctagggaagctagagtaaaaccaaacttattggccaactgccttggagccatttcagtcctccgcaacttagctcaggtggagaggccggcgctaccgagccgggttctttgcccgtcgggggacgctccgccgagacgaggtggggtctcggaggccccggggtccacttccagggcttttccgacctatcgggtggggggtggggcggggggcaggaacgcaccggaaccgatggcgagtcgagagctttgattctgcgtccggaccccaagagaggcgcgggccgccccagcaggggagcgagggaggagggtgcagaaagaggctccgaaattgggggaaactgacccgtgcttctctaccttcggaggtgggacagttgcacgaagtgctagttagaccggatcagttggaactgacggaggactgcaaagaagaaactaaaatagacgtcgaaagcctgtcctcggcgtcgcagctggaccaagccctccgacaggtgacaaccccgggtcacgccacccaccccagcctgggcccaaccccaccgcaccctacgccctctcagggcggcccacgcgtgttcccggagcagggtggcgagacgcctgcccggccgcgtgggtgggagcccagcctgagggccggggcgcaccgtttgggcgggggtcgctgcttctcttcatctcccagcccccagggtttgggaccgacattcactagttttcgagttgcttcctgagtagttactggagccggagagtcagctccattttgccaattgattgacgtgcggagtttgaatcctagcgcccccatctccaggtccagaccccagacgcgccgctcccctgcggggtttgggcccacagccttcgggcagggggcgctgtggcgtagacgtgcaggtgggcccggcgggtgtgcaagaagtagcactgtgggttggaacctgaaggtgcctgcctggtttcaggcttctgaactcccaacgaaaggctcggtccgtcattatttctttagtggccttggtcccactgccagggaggtttttcaggtccgaacgtgcaaggctgcccgttgtgtcactgcggaactgatggaatccccttattaggactgaggtgacctaaaaaccggctgttccggggtgctgacgggtgccggatcgggtagggcggggcgctaaacacctgtgcacagatgaatgctctgcgttctcacgacctctgccctagcacacgagcttcgagttataggagaaagctatccttcctggggtgtattcatccaagactttccagatctgtatacccaatacccgtatttgtttattagaagctggcatctttcttaagcctggcacatccaaacatataaaaagtaacactagggaatgatgtaatctgcaggcaacctgctgatgaaatgagacatctgacttaagtcttgaatgaattttttttgtaaaaacagaagggagaatgcattgacaagtttctcctgggcgcgaactgcggattgattggaaagcttccctacctcgaggaagctagacggttcgtgggaaaggagtctgtccaaggttgccccagcaccggtgtcacccatcagggcccttattgcggttttctctggctatcaccaaggggagctactttgcagagtttgtaaatcgtgcatcagttgcatccctatgtgtatcttgttcttgcagtttaaccagtcagtgagcaatgaactgaatattggagtagggacttccttctgtctctgtactgatgggcagcttcatgtcaggcaaatcctgcatcctgaggcttccaagaaggtaagagtgctggcttctgggaaaaaaatggttggagctttggggtgactggaggtttttaaaaatttttggtttattcaagtttctctgttcttaaaaagatgcatatagggagttatttaatgagtacagaatttcagtttgggaagatgaaaaagctctggaaatggatggtgtttatggttgcaaaatatgttaatgtacttaatgttttactgaaccatactcttaaaaattattaaaatggtaaatttggtgttatgtatatacaaagatactctttggtgacttaaaatagtctctttgtttacgtccaattttcaagatgcatgacacttcccttttccgaagctaatacagagtgtgaatttttgacatttaaaataactacaaagagaggaaagaactattctttagtatgtcataatatcctcatttgtgttggaaatgctatatcctagaaaggaaggaaaaaagaattaaacatttaaagttgtatttctaatcatttcattaaaaaggctacttaaataagataaccttatatctagtgaaaccacaatcgtagcactcttcactttgtctgattttaagtcaatgttcaaaacattcttgcatcaaaacaaaagggtcagcctcatcttttacctttgctcatttttctgacagagagaggattacagagtgagagaaatacagtcttactataggtaaaatgtgatttctctccctgggataaatactgaggggctgtgggaaaaggaacagcagagacaacccacccagtgtagccaatcattgttaatacactgtctcttaacaacttaaattagtttgagctgtaactttttattgtggtaggcaggcaccgagcttgaaaagatggaagtagaatatatttaggtacctgtataaggcaaggcttgcaatgaaagatgtagactgacaaatgacgacccaggcaagtaagtgcagattttatttcgtttaatatattatgacaattcaaaaagtttgaaggagtaactcaagttgttatgtcttcagaaaatcattccttttatacgagtcttagtaattatttgacaaaaggggaagaatttttttaaaaaattaaatgctagactagtcgctacatccttaccagaaatagtaatatgtaaggattacttttttactcccaaactcacatgacggaaggacaagacttaatcttttccctgttgggccagaggaaaatagctgttttcattatttaggtggagtgctttgggtgtaggaaaacatctggagaaaaattaagactttttcctcagccacagctattagaattttgattaaatacagaaactaaaacaattaatgttatagtgaaagtaattctgtatattcgttaaagaaaagggaaaatggcaaaacatgaaataatcctgccactcaatatattaaaatgtttttctctaacatgaatgtatttggatatattcttctagatttctgtagacaagcattatttacaaagagcattcatacggcgtaagccttttagcctacattatttaatagaacatcaacattgttataaccactaaataaaatactcagtattttaaatggacacaacaatttaaactgattattgttgaacatgtgagttattgtccttacaaatagcttttaaatgagcatttttgtaggtaatagggaggtttcatggttcttttggttgttaacttttttaaaagctgtgaccatgatgcagcaatactgatttcaaaatacagcatgaacaggtcacatctagtaaaatccaatagaaggaacttggagaggagatattttgcatgaacatttaacatttaaaagtcttaatttccttgatgttctaatgtaaaaatgggtaaaaattcccagcaaattaacacaatttcaaaattttaagaaaaatctgaattgagtttttaaaaggattatctttaaaagttatccaatgctgggttattttgttaagaaaaaaaaaaacaaaggaaacaatagtgtaatatttgtccagacagttgagctttgcttcgtagccacggtagtggtcctaatagctaagaacagcaggtaaccatttctcctttgcctttgggatttgtgagtttgtttttgtttgtgtttgaagtctaatttgagttcacaggtacagctacaatattgttcaagaagactaatgtgggactattatttggcacagaaataagccttttcagttaatcaggaatttactattctaatctcacttattactgaaaatatgcattattagaacccaatagttagaactacccagttttacaatctaatcccacacctgtgtgaaaactgaaagggctgctagtgctgcctgaaaatacagatgttctaaaatggttatggctggaaaaaattagtattaacagccagaaaatatgaagtataacagcacaaatgtatcacagcttcagaattgttttgaatggaatgcatactggagcacaaacattgtaatccactgccttaaaacaagaggaatttttttcatgagacttgtacataggatctaatatagaaacaggaccaacttttaaaaataaatctacttttacattaaattttaaatttttccattgtaaaatatgcttatattcaatttttaggttcctaattgtgagagaaacattgaaccaaattcacctagttaacattatctaccttgtccttcctcagaatgtactattacctgaatgcttctattccttttttgatcttcgaaaagaattcaagaaatgttgccctggttcacctgatattgacaaactggacgttgccacaatgacagagtgtatcctttaaatcattactcaagaatcatttgaaaagatagttccagaaaaggtaattcaagaaactttcaaacattttaaattttgtcagcatatggataaaattggcctatccaaaatttgtttactctgctgagaaactaaaatacaattatagacatctttgaaagtggttataattaatcagatggttggacggatttggagatggattttttggtggggtgatcacatgtagaataggattcagtttcagctgtgtaatgtgtgtgtgtgctgcagaaagaacatgaagactttagtgcagattctaaggccactttttcttggttactgtgattttagggtttattttggcttctttggaatgaagtcaataatttttttaattggtggatatatcccctttacaaactgctgttcactggtcccgcttttagcctcccctgagtttttcaaatacaagattatgctgattataataagccatctttggagatgataaaatggggtctggattgtcccccacattctttagttaccaaaataatatatttgatgcatgatatattgtaaaagtaattttataattacaaatctataatcatgaatgacccgtcatcttacattcattaagtctttcaaatgctaactaataagcaggcgtgtgctaatatatcagatgtaaagttgagtaattgttaccttgagtggcttcccaaaagccactgtgagagtcatcatgaagttaaaactaagttaacttcagtagcttgtgggttgtagatgcttattcccaaactttctcattcattttcaggaattaaaacctggtttttgtgttacttcacgattttttttcctgattgaagtttgctcgcatatatttcataactacttgtaaacaggtcaaatccgttttcatttgccttcttcttggagtcagttagctggaattttggcttagcatgaccagtagtgttgggaagagggtggaataagctcattgtgacagaattcttacaagaattttgttaaaaaggttagtacaccagaaaaattctcactggtttttctgttgggttgaatgttgtattagacagctcaagcttccataacaaataccatagaccacggagcttaaacaaaagaaatttactttctcacagttctggaggctgggatgtccaagatcagggtgtcagcatggtcaggttctggtgatggctcttcctggcttgcaggtagccagccaccttttctggggggatagcaggaggagttatcttcttacaaggtcactgccctatctaattagacccctccaccctttgaccatcatttaaacttaacttctaaagaccctctctccagatagttacattgggggttgggcttcaacataggactttgggggaggtggaggacacaattcagttcttaagtatatattaaactttttaatgtggatagttggtcttccacaaaatagagaaccagagtacctactgaaaaattagaaggcagtggaggaaaaatctaataagctatcttaatttagaaaaagacaacttctggctggacatggtggcttatgtctgtaataccagcactttgggaggctgaggagggaggatgggttgagaccaggagtgctgacaccagcctgggcattattgcgagaacccatctctacaaaaagtaaaatgaaataaaaatattttaacaaacgaaaaagataacttcagtaggaaaggaagtatattaaggattgttgtgccagggcaatatagagaaaccccatgtcaacaaaaaataaaaaaattagctggacgtggttgcatgagactgtagtcctagctacttaggaggctgaggtgcaaggattgcttgagcccaggaagtcgaggctgcagtgagctatgattgtgccactacactccagcctgggtaacagagcaagaccctgtctcaaaaaaagtggattttattcttaaatgttttaatatttaatatcgtacttgtacatgtctttctcatttaacaagttagaaatgctaataagctttcttagcaacggtttttatgttatattgctgctgtggtgagttattttatgactactattcagaggaatacttatttccctgtctaggctaccagaccaatttctgaggctaaaagcaattatgtccaatctgaatatcaacttgtgctcatctatgcaaagtatttctacaatgtctgaattgaattgttccgttctttcagagcattaaacattttccttgccaatatggaagtgacgctgaattgggagatctgtagtcattaaacattcttgatggttttgccaagtggacagaaggtcatttgctcttgaggaattacctgtttcacctggtaaaccagtgggggagggaaaggggcttctgtaaacacctggagaagagcagataagagaatgtgcaggttgaagtgtttaattttttttgtcgtgaaatacttgtatccttgattggttgttttaaacgaggatacagaaatatcaatttggaccctcagtgatgtcacaatattctaagtgttttggaaacatgctttattaactttacatccaagtaaatttaaaatttttaacaaaaatccatttttggctgggcacggtggctcatgcctgtaatcccagcactttgggaggccgaggcaggtggatcacttgagttcaagagttcaagatcagccttgccaacatggcgaaaccccgtctctgctaaaaatagaaaaattagccgggcatgatgacgcacatctgtaatcccagctactcagtaggctgaggcagaagaatcacttgaacccaagaggcagtgagccgagatcataccattatactccagcccaggtgacagagtgagatttaaaaaaaaattatttttcaaattttggagatgggtcctcatattttgccctggcttctctcaaactcctggcctcaagccatcctcctgtcttggcctcccaaaatgcagggattataggtgtttgccaccatatcctggcctcatttattttttaattagtaggctttatttttttgagatgtagtcgtgctatgttacccagcctggtctcagactcctgaactcaagcaattctgcctcagcctcttgagaagtttggattacaggtgcatctgctatacctgtaatctcaactttttattattattattatttctttctttgagacagagcctccctctgttacccaggctggagtgaaatggcgtgatctcggctcactgcaaccttcgcctcctgggttcaagcgattctcctgcctcagccgcccaggtagctggtattacaggcgcccgccactatgcctggctaatttttgtattattagtagagatggggtttcaccatgttggccaggctggtctccaactcttgagctcaagttatccacccatctcggcctcccaaagtgctgggattacaggcgtgagccactgcacccgaccccaactttattttttagaccagttttaggtttagagcaaaattgggcagaaagtatagtgttcctatataacccttgttacacacatacatacacactctcactcactcccccactgtctacatgctgcaccattgagcagaaagtatattgttcctatagaacccttgttattctctccctcttcctctccctgctccttcccttcctctccttctctccccgtgccccctcactgtgaaagtgctgtaccagagtggtacatttgttacacctgatgagcctacattgacatgtcaatattacccaaagttcatagtttacattggggtttacttttggtcttgtacattctatggattttgacaaacgtataatgacatctatctaccattgtggtatcaaaatacattgtagcaatagcatagtatagaatttttttgtttgttttgtttttttttacctgctaccttaaagtcttttatccctaatagaatagttttattgccttaagaatcctctgtactttggccaatcattcctccctctcccttaacccctgacaaccaccaatctttactgtctctgtagtcttggcttttccaggaggtcatatagttggaatcatgtagtatgtaatcttttcagattgtctttttagccggtaatatgcatttaagattactccatgtctttttgtggctttatagttcctttttagcactgaattccattgtttggatgtatggtttgtttatccatacacggtttgtttatccaaacatggtttgtttattcgcctactgaaggacatcttggttgctctcaagttcttgcaaatatgaatagtgctgttataaacatcacgtgcaggttttcatatggacataggttttttaaatcatttttatttttttttgagacggagtcttgctgtattgcccaggctggagtgcaggggcgcgatcttggctaactgcaagcaccgcctccaggttcacaccattctcctgcctcagcctcccgagtagctgggactacaggcgcccgcccatggctaattttttgtatttttagtagagacggagtttcaccatgttagccaggatggtctcgatctcctgacctcgtgatccgcccgccttggcctcttaaagtgctgagattataggcgtgagccaccactcctagcctaggttttttatttattttggtaagtaccaaggagtgtgactgctggatcatatgggaagagtgtcattttttatatctcactgcaatttttgtgtttaaggcagacttttttccagggggaatggtgagggaaagcaatgaggccttgcatttaaaaaaacagtatgtggaacttgaataatatgcagtatttcaaggcatttatggaagatgaaagaaaattatagtgtggtcttttttttttttttttttttttgggcaaagtctcacttttgctcaggctggagtgcattggtgctgtaatgctatcgtggctcactgtggcctcaaactcctgcaccctaggcaagtagttgggactgcaggcctgcaccactgtgccaggccaatgttgtgtatttctaatggaagaggacactaaaacccaagttgtagagtcacaaagtctgagctgagtataccctgctacacagcagctttgctttcctgggagttacttgtgtctaccgagccaaactttaatcttgagtattccaaaatgaaagctttgtaagtgaagtgctatgtaaatgaaaaagtaggaccattttgatgacaaaagggtttaggaatttttttttcttttttttgagatggagtcttactctgttgcccaggctggagtgcaatgatgcaatcttggctcactgcaacttccacctcccagaatcaagcgattttcctgcctcagcctcccaggtagctgggactataggagccctccacctcgcctggctgatttttgtatttttagtagtatttaaccatattaaacaggctggtcttgaactcctgacctcaggttatccacccacctcagcctcccaaagttctggttttataggcgtgagccgccacacttgaccaggaattgagtgtagttctggttcttatttttggcacttctttccctcttttgtctttgtatttgttctaaaacgcctttttttttttttttttttttttgacagagtttctgtcttgcccatgctggagtgcagtgcgcaatcttggttcactgcaaccttcaccttctgggttcaagcaattctcctgtctcagcctcccaagtaggtgagattacaggcatgtgccaccatgcccagctaatttttgtatttttagtaggtacggggtttcaccatgttggcgaggctggtctggaactcctgacctcaggtgatctgccctcctcggcttctcaaagtgctgggattacaggcgtgagccactgcgcctggccctcaacacatttctgatgttggtgttaggcctttgagttattccagttgcattgttgtctgcttttgaattatgtgatgctagctgagaagacctcatctagcaggtaaactggattgcatgttgtaagctttttacttaatcaagtgaggatggtgagggtgtgagatgatagggacgggggcttctgtggtttttttttttgaaattatcttagatcccttacggaaattaatactagttatctcctgctgaaaggacatttgtgtaaatggcttcttttattcattttcttttaaacccatttttttccccactaatgttggatggaattacttcctgatttcttaacctgctttttgttagctgtttgtcaggaacttacttattctcactaatcaagacttctaatattgtgtttacttccctttgccaagcatttattaagatcttatttttctgaaagtgtggtaaggaggacaggtgaaaaaaactatcaattgacttcttactacatatgccatgaacggctcagtggggagctttcatccccattttatcactagggaaactgaggcttagaggctttgtctttaagttatatgctctagcatccaacaatatacaaggtgaaatattttagaatgtatacaatcatttgaggcacgttggctacctcaaataggttatctcccttttaagttaatatcctgtgtttcctcggcacatatcaaaccattaaagcagtaaagttaattttgtaaaatatgtattccatgatagggtattgcatttgtatgtgctgtttgacgtgattatgattgccatttcactagggcaaatttccattatcaggaaaaaaaaatcactaaactgctcatgcctacccattcaaaggttattagggtgtgtatatttcatcacttcttggggggtgtaaaggatttgggtgtgtgtgcacatatgtgtgctctattatcagtgtgtgacattagcctgtttttcctgtaggttacaattggggataataggatagtagttaagaacatgaacactgggggcaacttatttgaatcttcagcctcagattccccatcttaaaatgggtaagactattgtataaggattaatgagataatgtgtgctgccacttagctggtggttggcctgccccacactctgcaatgttgactgatcctgtggaccccaccaggttgtcgggtgtctcagaacaggaaaaacggctggcaagggactttgaaaaggacttccttattgttttaaaaccttatgtaaaccattttacacatataaatttttttaaccttatgtgagactagaggtagacctttcaaagcatcagctacatgttagtacaggtaaacttgaaggttaggagtttattctaacagtgaaatgagctggggctttataattgtacaaaccttccctgccctgctgtaaaggtgaaggcaaacaccgaatcctcattggtacttttctgtgtatgaaagggatatatatatatataaaatcaagtatacagttaagctggaccagtagttgaccttgttagctggaggtggaaggaattatctctggcatcacattggcataacatgagccaaatcggcatggacactggcctgtcatctgcagtgagtgaagtgactagaaatactgcatattccttgccagccctcagactgatgttaattacgtgtggtttgttttaattataaaatattttggcctggtacagtggctcacgcctgtaatcccagcactttgggaggcggaggcaggtggataatgtgaggtcaggagtttgagaacagcctggccaacatggcggaaccccgtctctactaaaaatacaaaattatctgggtgtggtggtgggtacctgtaatctcagctactcaggaggctgaggcatgagaatcgcttgaacctgggtggcggaggttgcggtgagtcaagatcgcaccattttaccctagcctgggcgacagagtgagactccatctcaaaaaaataaaatattttacttttaaaatgggagtttggaaattccaagttaatccttttgttttagaaagcttcggaagacttgttaccaaggagtctccttttcctaatttgtttatcccatataaatgtctttttccaaagtaaagtttttcatctcctttgttgaatgagaccctatctccatcttctttcttctagggtataattgacttactaggtttgttggaaatccttctgtgtgactcttcagtacaataatatctccaagaagtaatatttgttaggtagggatcttattttttaccctctaagagtaagaggctgggtgcagtggctcatgcctgtaatctcaccactttgggaagctaaggcaagaggatcactggagcccagaagttcaggaccagcctaagcaacacagggagaccctgtctctacaaaaataaatctaaaaattagctaggtgcttaaaaataagcacactcctgtggtccatgctacttgggaggctgaggtgggaggatcacttgagcccaggatgtcaaagctatagtgagctgtaatcacgccactgcattcaagcctgaagatcctgcctcaaaaaaaaaaaaagaaaaaaaaagtaagctgagaagtaaggtttaaaactaaggttgtattcaacctgagaaagctggttgggagaagacaaaactagggttttaagtatgtgtgtatctgtgtctgtgaggttttttgggttttttgtgtgtgtgtgtgtgtgtgtgttttgttttgttttgtttagttttttttgatacggcgtctcacccaggctggggtgcagtggtgcgatctcagctcattgtgacctctgcctcctgggttcaaaggattctcatacctcagcctcccaagtaactgctggaattacagatgtgcatcaccacacctggttaatttttgtattttacttttagtttcaccatgttggccaggctggtctcaaactcctggtgtcaagtgatccacccgcctcggcctccctaaatgctgggattacaggggtgagccaccacacttggcatcttttttttttttttaattttatttttatatttttcactcctctcagctcatacctaggttttagatgtttttcccccgcattttattgctggtgttaaatagttttggttgtcttgacttctcattgtattttcttatggtgacattttttgtttccttcaaagctcactttaaaatatatcaggttatatgtagaacttacatttaaaattatgcaaccaaactgggcacggtggctcaggcctgtaatcccagcattttgggaggctcaggtgggcagatcacttgagctcaggagtttgagaccagcctgaccatctggtgaaaccctgtctctacaaaaaatacaaaaattagccaggcatagtggcattcgtctgtaataccagctacttgggaggtcgaggttggacaatcatttgaacccgggaagcggaggttgcagtaagccgagatcacgccacttcactccagcttgggcaacagtgagaccctgtctcgaaaaaataaattaggcagacagctaggtttggtggcacactcttgtaatgccagctactccagaggctgaagctggagggtcgcttgaatcccaggagttctgggctgcagtgcggtatgcccatccagtatccacagtaggttcatcatcaatatggcgacctccgggagtggagtggagggttgcctaaggtggggtgaactgtcccagaaacagagcaggttaaaactcatgctcttgtgctgatcagcagcgggatcgcacctatgaatagccaccacactccagcctaggctacatagcaggaccctagtctcaaaaaaaaaaaaaaaaaaaaaatttttttgagacggagtcatcgtctgtcgcccaggctggagtacagtggcgcgatcccggctcactgcaagctccgcttcccgggttcaagccattctcctgcctcagcctcccgagtagctgggactacaggcgcgtgccaccacgcccggctaattttttgtatttttttagtagagacgggggtttcaccatgttagccaggatggtctcgatctcctgaccttgtgatccgcccaccttggcctctcaaagtgctgagattacaggcgtgagccaccacgcccggcccataaaggtaactcttttaagagtaacatctctatcacatgattttagaaaattcagtttttagttagaagactaataaacttttctctttttttcttgctgtattttatcagctactcctttgttcattagcataggtattataagtctggcagcatgaaattgtgttactatacaataaatgaaagtaaacaaaaggaatggatttaatgtcttgtgacatttttcttatggcaaggaaaaatggctttcagatgacacttcaaattggagtaattataaaatagtttaaacttgtctgagttaatgtattaccttattaaaaacttagtttaaaaagatatttacaagtaaaaattggatgttctgaaaccagatgtgaccatttttaggtaattgggaaggataactttttaaagtagataagctaatattgataaaccataaaatttctctctgaattatatcctcagctaatgtaagtgtggattaaatcctcaagcctgtttcaccagtggtggtcataaggaaagtgtccctcctgttaatatatagaccaagtctctctagactcctctaacatgcatataaagttttacttgctcagttgcagcctgaaatgatgagttttgttcccactgcctctgcctgtacccttcctcatttccttgaggcatttctcatttgtgaagctggctaagcctgtttgtactgttgtgactgccttgagggcagaatgagtaagttgcatgaggagctataaattaggaggcacagactcatctttcctttcctcaagatcagacgtgcagcaagtaatccaatatatacttataaattgataagggaaagaattgctactaaaactttttttctcattcctctctgttactcgttttcagtgatgctaaggatcatagattgaagaaactggcctattgaggctgtgtgcgtgtgtgtgtgtgtgtgtgtgtgtgtgtgtgtaaggagatggcttgggcattcaggaggttgggtgacttttacaagttgttacacagctcagcaccactcatcctggtgtgacgctgatcctggtgtgcgatggctcaaagggagacatgttgggacgtgttatgtggcaccaaggtagtagccaaatgtcaagaacattttctgagttaaaaagtagaattcattaaaatgattcttcagctacaagtctatttctaaccaggcaggaatgctttacatttttacttttgatctctgtcttcttcagttggcttttatctatgaatttataaaacttctctcacactattgctcaatagtcaaatcatagctttcgtgtaatcccacctccattacccatcagccaggtgactgggtgaactactgaacatcactcaatcccagtggtttgtttgcgatggagtcttgctctgttacccgggctggagtgcagcggccatgatctcggttcactgcaacctctgcctccagggttcaagcgatttttgtgcctcagcctcctgagtagctgggattataggcgtccgccaccacatccggctaatttttgtatttttagtcgagacaggagttcaccatgttggctaggctgatctcgaactcctgacctccaagtgatccacccacctcggcctcccaaagtgctgggattacaggcgtgagccaccatgcctagcctcactaaatcttagttctacaactgtttggttttgctgtaatttatctgtcagggttattatgagaattggaagaaatagggagtggttggcacaaaatggtgtccagtaaatgccaccatttaagtcagcagatccttggaagctatagagatgttgataggtggaaagagatcagaggaagatgggggcctacacccaggaaatgttacaacagtcgagaaaatagcataacattttaggaatagtatctaatgaactcttaaattgacgattgtggcctagaacagttttggtgggtcatttgtggcctaatttggttaggggattaagataagagtgctttccttatagggtggtacctgagcactgttgagaaggctaggtaatcctgccattaatagatgagaggaaagcttaatttgaatggaatatacttttatactcctttcaagtctaaattttccccatattcttttttgagattgattgacaaacattcctgtggcatcctttgtatctggccatctttttgcaatctccattcttctgtaataggtcacaggtcaataaccgtttgctataaggggctagaaagtcaatgttaggttttgcggagcacattagggtctgctcacccaggtgcaccttgttttagtgtgcttcactttattgtgattcacagttgttgtattttgtctttttttaaattttcatcttttatttttgagacagcatcttgctctgtcacccaggctggagtgcagtggtgtacttttcgacctcccaggctcaagcaatcctcccacctcagcctcctgagtagatgcaatgacaggccaatttgttattttgtagagatggggactcgctatctcaggctggtcttgaattcctgggttcaaatgatcctcccacctcggcctcccaaagtgccgggattacaggcgtgagccaccgtgtctggccagttttgttttgtttaaaaaaaaagaaaatggaaggtttgtagcaactctgcattcagcaagtctattgacaccatttttccaacaacatttgctcacttgtctctctgtcacctttcaaactttttcattattctgttgtggcgatctgtaatcagtgatctttgttactggtgtaattgttttggggcaccataaagcagggccatattaggtggcaaacttaattggtcagtgttgtgtgtgttcggctgctccaactggtggttaccccatctctctccctctccttgggactccctattccctgaaacacaatattgaaattaagccaattaaccctacaacagcatctaacctttcaaatgaaagtaagagtttcatatctctcactttaaatcaaaagctagacatgattaagcttagtcaggaaggcatgtcaaaagctaagggaggccaaaagccaggccttatgcaccaaatgatttgtcaagttgcgtaaaggaaaatttcttgaatattccagtgaatatatgaatgataagaaagcaaaacattatagggtgttacctgagcaaagatgagaaggctgggtaccacttgtcatttatagaagagaggaaagtgtaatttgaatggaatatacttattgctatgatatggagagagtgtgagtggtttggatagatcaaactagctaccacatttccttaagccaaagcgcaatctggagcaaggccttaagtctcttcaattctatgaaggctgagagaagtgaggaagctgcagaagaaaagctagcagagattggtttatgagattcaaggaaataagtcagctctacgacataattcaaagtgaagcagaaagtgcttatggagaagttgcagtgagttacccagaagatttagctaactgatgaaggcagctacactaagcagattttcaatgtactagaaacagccttctcttagaagatgatgccatcctggactaacatagctagagaggataaatcaatgctttgcttcaaaagctgattctcttgttataggctaatgtagctggtgacttttaagttaaagctaatggtcattaaccgtcctaaaaatcctagcgttctgaagaattatgctaaattggccggggtggtgactcatggctgtaatcccagcccttgggcaggccaaggtaggtagatcatttgaggccaggagttcaagaccagcctggccaacatggtgaaaccccatctctactaaaaaatacaaaaatgaggtcgggtgcagtggctcacgcctataatcccagcactttaggatactgaggcaggtggatcagctgaggtcaggagttcgagaccagcctggccaacatggtgaaaccccatctctataaaaatacaaaaattagctgggtatggtggcgcgtgcctgtaattccacctgctcgggaggctgaggtagaggttgcagtgagctgaggttgtgccactgcattccagcctgggcaacagagcgagactatctcaaaaaaaaaaaaaaaaaaaaaaaaaaaaaaaaaaccaaaacaaacaaacaaacaaaaaaccaaagaaaaccaagaattacagtaagtcaactctgcctgtgccctcaaacagcatcacaggctaccgaatctttgatgaaaggaagaggcaattgatgtggcaaacttcattgttgtcttattttcagaaattgccacagccatcccaacgtttagcaaccatcaccctgatctatgagtagccatcaacatctaggtaagatcctccaccaacaaaaagattgactcactgagggctcagatgattaacatgttttagcaacaaagttgttctgttgttttttatttttggagacagagtctacctctcgcccaggctggagtgcagtggggtgttctcagctcactacaacctccacctcccgggttcaagcgattctcttgcctcagcctcctgagtagctgagattacaggcatgcaccaccacgcctggttaattttggtatttttagtagagatggggtttcaccatattggccaggcttggtctcgaactcctggtctcaagagatcctcccgcctcggcatcccaaagtgctgggattacaggtgtgagtcactgtgcccatctgcaacaaagcatttttgaattaaggcatgtacattttttaaaagacataatgctattgaatacttagaacagtcaaaacataacttttatatgtagtgggaaacacaaaaaattgtgtgacttgctttattgtgatattcactttaatgcagtggtgtagaaccaagcctaccatattttcaaggtatgcctctatttgatggaaatacatccttattttagagagattcgcaaaacttcatgtgaattcctggtttcaccctcaaaccaagtttgagctatgtgtttcaaagagtatacttttggtaaagaagcacattggcctgtgttggctctgagtgcttgaattgtttccaaaatttgctgtctagaactagcatctgctgtcatcaaaggtggactatcctacagggctccaaaagtgttctataatagaatttctaagcaaaagtggcattgtggaagtaatgtcacatcaataatctgtggtgtccatttcaaacattaggccaaaaaaaaagtcatttaataccttgtagtgttgataatgtcaccatatcatgaagtcggcatggtcattgccttgtgtgtgctgtaaagattcagaggatgaaatattctaattaactttgttgcatactttgattcaaaatgaaatgaaaatgctcagtattcatttgctacaactgggtaaataaaaattgtattcctggtaatatctcagcactggattgatttgcctcttttacccaaaagggcagttggagcctaagttgaatgactgactgatgggaggcagccattctgagatttctaaaggaagctcagctagatccatcttcttcctcttggcttggtataggtttaattttgatttagaagtaacctgattttacctttccaaagtgtttccttaatttaatctcacagatttaaattttgagaagagtagttcagtctctcgatatggagcctctcaagttgaagatatggggaatataattttagcaatgatttcagagccttatagtaagtattgcttttatagtagtgcagtcccagaattcatactatttttctcttacctatactcaaatttcctcctacaactttgtctccctaatcactaaaatgatgacttttatgttctcatttttagatcacaggttttcagatccagagagagtgaattacaagtttgaaagtggaacttggtaagtgcttgagtactatttatttgagctttttaacttgttttttttttttgtctgtttgtttgtttttgagacagagtcttgctctgtcgcccaggctggagtgcagtggcacgatctcagctcactgcaagctccgcctcccgggttcatgccattctcctgcctcagcctcccgagtagctgggactacaggctcccgctaccatacctggctaatttttttgtagttttagtagagatggggtttcaccatattagccaggatggtctcaatctcctgacctcgtgatctgcccgcctcgcctcccaaagtgctgggattacaggcgtgagccacctcgcccggcctttaacttgtttttgttcatattgtgcctcttaattcttgttatatttgagaaactttactaatccttttagctatcctttcttgctgttcggtcatctgtaaaagaaggttgtattacttagagcttgatattgggaataaaatgtaatgacttactggcatctttagtcaccctgaccttaagtatattatatgctcatatctgtgattgttattttggtctccccaaactatccgatctttcatttagaaaatttccaaaggagaaattgtaggctttaatagagttcacaatttttactgagataaaattttacgtacattctataagtacatttatttatttatttattttagttttgagacacttgctctgttgcccagctggaatatcgcggtgtgatctctgctcactgcaacctccgcctcccgggttcaagcgattcttgtgcctcagccttcccagtagctgggattacagatgtgtaccatcatgcctggctaagttttgtatttttagtagagatggggttttgccgtgttgaccaggctggtctcaaactcctggcctcatgtgatctacccaccttgacatcccaaagtgctgggattacaggtgtgagccattgtgcctggctatataggtttctactttaaagccaaggaaatagctggggagaagtatgaagtggtgtctgttagtgatcgcaggtagacctgtttgtaaatcactctaatgaattgagtgtgtgcttggtctctgaagtgaatagaaacttctgacagctttgcccatagagagagactttgaggccgattagttgtggagaaagtgacttattaagaaaatgtcctaggagaactgaaaatgtgaacgtgggagggataagacatcaaaaggtgtcaaaatatataataagtgatttgcaaatgagtcattaaggtgtagggactcacaggcatttctatggacattctctgggatggctccctggtttgatctgggggatattttaatggcagacttcctaccatgcacacacattcctcatgtgggttaattgtcagctttattctgatcctaaattcggctgctaaactggatttaaaccccacatgtatactgtctagatttgagaatgaattcaaacctatcttttggggttctaggaactttcaggacatgagggtgccaagcaaacatttcctcagctttttttttttttttttttttgagagggagtcttgctctattgcccaggctggagtgcagtggcacaatctcagctcactgcagcctccacctcccaggttcaagtgattttcctgccttggcctcccaagtaactgggattataagcgtacaccaccatgcccggctaatttctgtaattttagtagagacggggttttaccatgttggccaggctggtcgcaaactcctgacctcgggtgatccacctacctcagcctcccaaagtgctgggattacagacataagccaccacgcctggccttcctcagctttgatagatagatggtttgctgagtgagctagctgtgttgggcctgcacaggcagccatgtttctataatgaaccacctaaacagtactttgagttgtacccacataatttttgaggttataaggaaaatcaagtagtattgctagtctgtctgaacaccaaataatacatcctgtgtaactaggcagttgtcttgcagggggtaataggtgtctgacttgctagcatttatcatgcaacctgaagttttgcttcatccacagcagcaagatggaacttattgatgataacaccgtagtcagggcacgaggtttaccatggcagtcttcagatcaagatattgcaagattcttcaaaggactcaatattgccaagttggttttcttaaatatctattttacttaacaatcccaaagggataatggattttctatcttttttttcctcactgtatttttttttctacctgctgtctgttttattattctcaaaggggaggtgcagcactttgtctgaatgctcagggtcgaaggaacggagaagctctggttaggtttgtaagtgaggagcaccgagacctagcactacagaggcacaaacatcacatggggacccggtatattgaggtatgtcctcaaaacctgaacccctggacatcgtgaatgagaattaacataggacggaaggctcagaaacactaacttctctgtcttttctcaggtttacaaagcaacaggtgaagatttccttaaaattgctggtggtaagtgccttttacataatgtggctttagttaataagaatctaaaaattttgcatacttaaatttagcaagagtaggtgaatagggtcatgaatggtttttattttctaatggaacatgggaatagattttcttccccagaggtagaagcttccgataataacagtgagcttaatgtataacacttgtcctaaggcttgagccaacttactatagttaaatagccattaaaaatagtactatacaaaggtgaaaaggtgatatgaagttgtatgcatatggaaaggctaggtttttttgttttgtttttttggagacagagtttcgctctgtcacccaaactggagtgcggtggcacaatctcagctcgttgcgacctctgcctcccaggctcaagcaattcttgtgcctccgcctccgtagtggctgggtttacaggtgtgtgccaccatgcctggctaactttttgtatttttaatagagatggggtttcaccatgttggccaagctggtctggaacccctggcttcaaattgatcctcctgcctcagcctcccaaagtgctgggattacaggcctgagcccctgtgcccggccaggaaatgatattcttgaaaagagtcagaaaactgctttcaaacggccacgctgcaatacctgggattgttgcacatgtgcttctaatttttctctaaacttaacacatgagtcaccagaaacatggtagttttgggtctcgtagtatttttggatgtgtatttacagtaatatggttaaaaacagggtggaacagatgtggtttttatccagttatttagtgattaataactttaaaggaagtaacatgcataaaacgttgactgctttttgtctgatttttttctatatatatatctactttgtaagtttctgttgctcattcatattgttttataatttccttttaatgtatattaacatcatcctacattactcaattttcttaaatgttaattgctacatagtattatatgtaccataatattttgaaacatctctgttggagctgggcacatggcttgtgcctgtaattccagctacttgggaggctgagacagggaggattgcttgagccttggtgtattttgagaatggcctgagcaacatagtgagattctgtctgtaataaataaaatatccctgttgagcatttagaactcatttccaacttttgactttaatatgttgtcaatattttaaaatctctgtatgcgccactcattgggataaatctctaaaagcaggatagctgaatcaaagaattttggaccttttcaacagccatttgacacctattgccaaattatatgaagatgactttcactgtgtaaaagaacatttgtattcctacattacagagcctgggtgaaaattttgcagctatagaacttaccggaacagcatcctattaacacaatctgctggtatatttttgctccagttcatctttagataaactctaaggcttcaaaattcaggacttcaaatttaggagcatttccagagttcccaagcaatgtttgatattgttaggggtcaaatatatttggggttgctgtggttttacctaaatcctgacatttcatgatagatgcattgcaacttggagatggcaaagtcaattgtttatatcatttctgggatttcattgtatatgggcactgcgataagaatttgctattaggggctgggcttggtggctcatgcctttaatgccagcactttggaaggccaaggcaggcggatcacttgtggtcaagagttcgaggccagcctggccaatatggtgaaaccccatctctactaataatacacaaattagccaggagaggggtgtgtgtgtgtgtgtgtgtgtgtgtaatcccagctactctgggaggccgaggcaggagaatcaacttgaatctctgcggcggtgtttgcagtgagccgagaccgtgccactgcactccagcctaggagacagagtgaaactgtgtctcaaaaaaaaaacaaaaaagaagcaaaaagaagaacgtgctattagggaaaatgttactagtgtatgagtttcaaagatatgcatttaagtatttgctatatgacaacactgtacaaaatgttttatgttgggcagaatgttgatcaatattgaaagtaggtaccccatatattcattatactattctttttactaagaatgtttgaacctttcttaattaaaaaaaaaaaaggtaattgagttacttgcagatggttttcttgggagcaaaagagtaatcaggaaaagatttttttaacccaaagtgctttatatctattaccctacttaattttcataatttatgacataggcaatcttacagacaagaaaagtaaggcacggagttgaacttgactaagattatgccctagtaagcagtaaagccaagattggacccaggcattctggctccaggacctgtgcctttaactaccacaatgacttactagtgattggcccgtgatttaattgtcttgccagcttcctaaattaagaaggatgttttatgaaaaaggggaggagtttcaaatttagaaaattctgatttctaggatgttattttgcgttcagtaggagtatgggtcttcattatgaactcaagacattggcaggacttttatcactttaaaatcggtaaagttgatgtcttaactatttctctccctgcttcctaatatttgttttccctaggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggttggttttaaaaacaagtatgttgtacctttgcattaatttctgttctttatctctgaaaatagtcctacattgctcattatgttaaaataaaactggcaaaatactaaaagtgtaactgcatgaaaatagtcttgattctataaccaagagatagccgctgttatcctgtacacacacacaacacatactacgtatttttacagaaatgggatactgctatagctggatttttgtattctgttttaaaactatgaaagcttacctatgtctgaaaagtttcatctttaaatatctcatggaagtgcatactttatctagaaattcctctagtgtacacttagattgatttttttctaccagaagaaatttctatgtaaaatgcttaaaaacctgtcatcaatttgatttctgtagcattggatatagagtgtgagcttttaaggtttttaatgtgttgccaaatgttatttcccaaaaggcttcatcggtttcataccctgctggtgagctctgtcctgttttactagctttcagcatgtgtgtgtgtgtgtgtgtttgagatggggtcttgctctgtcacccaggctggagtgcagtggcgcaatctctgctcactgcaacctccgcctaccccagttgaagcaattgtcctgcctcagcctctgagtagctggcattacagctgcctgccaccacacccagctaagttttgaatttttaatggagatggggtttcgcggcaggctgttctcgaactcctgacctcagatgatctcccacctcgggctcccaaagtgctggaattacaggcatgagccaccacgcctggcaactttcagcatttttgaggcacaaaatgaggcaatcacttcctcaaaatgtactaagatctaggcattaaaccatttatagaatctcaagcttttcgactgttcttgacttgccagctaccaattgaacatgtcttcaggggtcagtttgcctttgtagcataaatggtatagactgcttttccaacttgctctatttgtgtcccatagtagaatagtgattcatatgattccacaggtctgctttgtaagtatttaggatacttacttaattatttctgtgagttcatcagagttttgtgtagcttctgcatcccattatatgttgtgattttaaataattatgcaaagttaagaacctttttacctactagaatgccaaaattatttttgtacttaaaataagtataattgaaattctaaattatttttgtgttccattgtactggtgctcttgaaccctaaactagctacattcttacaatttaaaatttaaatctggccaggcgcagtggctcacgcctgtaatcctagcactttgggagtccaaggcgagcggattgcctgagctcaggagttcaaaaccagcttgggcaacaaggtgaaactccatctctgctgaaaatacaaaaaaaaattaggcagtcatggcagtgtgcgcctttagtcccagctactcgggaggctgaggcaggagaatcgcttgaacccgggaggtggagattgcagtgaaccgagatcacgctgcactctagcctgggcgaccaagcaagactttgtctcccgctaccaaaaaaaaaaaaaaaaaaaaaatttatacctttttgaaaatgtcataagtgctgaatctctaaaatgtgcttgagttttcaaacatgacaaacattcttcccaaaccaggagaaaaaactcgatgtggttgcagatctttatttggaaagagagtttgtcttatgaaatcatggcctagaataagctactgcagagcctgggctactctgttggtttggaaatagagtaggctgcctctctatgattctactatgagttgcttttgggtgtgcattttctctacttctccatccttcttgatttatttaataagttttgaactagtcataggttcttccactgtcttttcttcattactagtcattttattcagtaaatatttgagcacctcttaattgtcaggtattatgagatgcttcaccatttcctgtcctgagtttatctattactacactaattttctattcttgttcttctaatgtttttgctgtgtctggattgtttatataacttcttattaaagtcttcttgtctctttttcatgccgtttctctggtggtgtggtttgatttttgtcccctcttactcagatagcaactgagcagggtgtgagtggggaaattagtgcatgttttggggaagggttcattgattcttctatattgtcaatttatgggatgttaaaggctagagtgattaagttgttcagaaaacctggagatgccacagatggcatttgcctaaggacttctagtattatgaactagttggcatgctctgagacaaaagtggacaagagccttgtaatatgagtgttgcctaagggcagtcttttgtctaaaattcgcctaacctatcatcatccatttccaagatagctgaattccatgaatctagaagatattcaagatcttttgtcttaccactgtctcaaattcacagggaaactaaactactattcatctttacggtcaacaaatgattcttttcaggtctttatacccacccattctgtcttgtgctattattcagcattatattttaatataatccaaagtgattgtttggcctgtgattcttttactgggtcattctctatttctttggtttggaggtggagtatgaaggtaatgaggggaatactgtgtacttagtgaaatgatatatttctacttttgctacaaaagtccacatttagtgatatgttcagaattgtataaaagtggcagctttagggataatatccctcacagatagtgatacattgttacaggtagacactaactgtttaagtgttttgtgttgtgtgtggtgtacacctcacagtgtatttgacaaaaatgagtatcatgctttccctgctggaatgcatgaatccctttctccattacttctcaaacttgcatgtacttctgaatcacttgaagattcagttcagatgaagattcatatttattaggtctggggtgagctggattctgcatttctaacgagcttcccagtgatgccattgctgatctgcagaaagcaggggagtagcacagctctaaattacttctgttttgctttgagtacaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccaggtaagaaagatacttagtggaaaacttatttgctttttctcactacatatgagaaatatctaatattagatattagataatctattagaaatatctaatattagatattagtctttgataaataaaattagtctgagataaatttagatgaaattagtctttgataaataaaattagtctcacatctaattaaaaagtacgtaatcctcagttacacactaagtctttaaggaaagacttaactgtaaatacaagaggtctttagaatgaactgaaaataatgctgtcgttagtataataattcaaattcagctttgatttcttcatcacaaatatccatcacattatcaatagcgtcaagtaggcatgacatatattatcagtcttgacacaatttttcttattttggctgttcaactctgcaactctgctgtagtgttacagcaatcatggatgatgcttattttaacaaataatcatatctgttccagaatattttgtatccatagactatttagaaatggcttatttcatatttaatatatacatgttagacatcaaattacattcaataggaaccaaactcagtgaggacttgaatccataccacctagaaagaacagtatgtgtggatcataacaggctctcaaatgtattaatgaatgagttgctgagaagcctgtataaaaatctaactgaattcttccatatgcaaatgtaaagtatttcctagcttattgtcacctaatttttggttaaagaaaattatatttgctggaaaatttaacagtattttgtgctgtcataagcaagatacaattctacaaacccataagccaggtggttgtagttgaaactttggaacttttttttttttttgagacagagtctcactctgtcgtccaggctggattgcagtggagcaatctcagctcactgtaatctctgcctcctgagttcaagcaattctcctgcctcagcttcccgagtagctgggattacaggtgcccaccaccattcccggctaattttggtatttttagtagagacaggatttcaccatgttggccaggctggtctcaaactcctgacctcgggcgatctacccgccttggcctcccaaagtgctgggattacaggcgtaagccgccgcacctggcctgggactcttaattaaatgcaaagctgtattaatttttgaaaatgttttctgaggattaagggttgaatgtaggcttatattgaaaatactgaatttttttcccctaaattgctaatttctcaccttttcacttggagatttggtcactttcataactgtaatcttgtctcactggaaagcctgtaccattggatacaaggaatcagaaaccatcctgagcccttgccttctataccagttttctgcatcagcacatgctcattctaagtcttcagtcaatattgatattaaattatgcaacttgttatctgaccctctcagcatgcttcactggtagcagttcttttgaataaaattgcccacatttaagcatcaccagggaattatttggtttcttattgagtcaccacttctaataacccagaggccattactctttgattaacaacagtatttgtctctctttgcctcatgtgacctattgtgattacacttgggaaaaggttcttagatgatgcacaaactcttaggtgccttgaggatgttaggtttccatcttggactgggtttgttgctagtttccctggtgtggtaactctaatggtaacttgcatggtaataatttcacagtccttaagagacttattgagaaaaccataaaataagaaagtagtcctgtaagctgatcatgtctttttctcccccataaaacattcgtgctcaataaaactaaggcgttctacctctgtggaacacaaatctacaggcttggtttgaaatagggggttttagcaagctattactaatagaaaatgtctgttagtaatacctgtttgaccaaggtagagctgtaaggagtgagagaagggctcccaagcaaggctgatgatacatacagctctcacaaatcatcactgggccttgcacctcccaaattccttgcccccaagccacattccaacctaggtctcagggatgagggaagattgaaagggatatggcaggtcagtgatggactggaactgagagccaaaaaagaataccggttcagtttcctgtaggagggtacctaaagctccagtgctggttctgttactagcttttctcaattgaatgagatttaatcgaatttttcagaagagaaaaaaactagtatacgatcctatattttgaagcagcagtcacaaggagaccctttcaaacccttgtaaatctgatactaattaacagaagtgaaaaaggctcattttcagctatgagctctcaaaactgtttcttaaaggttttgttggccattctggtgatcaggtgatgaaatgcaagtcaggttccagcagatcacaccatcacccggattttgtggctaaaatatctgtattatgggtgattgtcactttgcatgttttgtaagcaaccatttccttgttgaaggagacagtctccttttgtttttattcttcccccacacactcagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgtaagtttttcttgggtcttggcgctattctacgctatatgctggtaggtgcttaagctgctttcgtaactttctgtgcccctggttctttctgaggcaggtgaggtggttatataaggctctcccatctgtaatcagtagtacctggtaatcatttaagaccttggttgtggacacccataattagagatgctacaaatacctcctttcaaattatattcctgcttttccagtgataagcacttgatttctgaagcttagtgtgctccagataagcactgactctgggaggcaacctggctatatagataattttagtacgcatttaaaggcaaaataaaagtatggctggattctttttattttattttttaaaacgtattaacctttaagaagggcagtttgatgcacatgttgcatttaactttttgagcatcaagtatttttttaacatttttgagcatttctgttgctctccaggatatctggaatgagcaagtgagcaaaaacaaaaaacaaaaacaaaaaaaaccacatagattaattagccaaagtttccattggatcacaggatcagtgcttaattttaagccatgctctcgctcattggcacctgggtgcaagccatctggaatcctatttgaggggaataagccctgtagtctacgaagttctagttagtgaataaggaacatatggggatctgatgttaaaatttgagtcttttttacacaatttttcctttaaataagatgtaccttcttaggcctgttgggtatgtttaaagaatatagtatttgcagtacagttcaaagataactaagtaaactggattatgtgcttgattccaataaagcgggggatttgggcacctcactttctaataagatggacctatactaatgatcttgtttggtaaagtattatttgtagaacattcagtggggcttaatcctttttatcttttagcattttgaatttctaaatgctaatattccatttacctgctgcttgctgttggtgaatatcttagagttgatcattaataagtatgaagttttggaaatttataattgggttaagagatcttacagtaatctcagttgtatgtcttcagtatataaaccactggtaatgtcagtagcttttacgatatcctttagtgataatctgtcaaacattgtaagataaagcatcatgtgtgacccaaattctgcttttggaatatcctttcacttgtccctcctcctggtcattacagatttttcctctgaagactttcatttttacccatttttcctcacaagcctccaaataaaaaagatttaaaatccatgtgtcagccaggtacagtgattcacacctgtaatctcagcactttgggaggccaaggtgggaggatcacttgaggccaggggctcaagaccagcttgagcaacataacgagtttatgtttcatttaacttttatgcaacttcttaaagtttgttaacttactttcttaagaaggaatgttttatggttaacttcatttttgtagtcagtgcatatacactactttagatatataagattagctatcctaggctgggcatggtggcttacacctgtaatcccagcactttaggaggctgaggcaggtggatcacataaggtcaggagtggccaacatggtgaaaccccctctctactaaaaatacaaaaaattgccgggagtggtggcgcacatctgtgataccagctactgaggcaggagaattgcttgatcacgggaggcggaggttgcagtgagctgagattgcgccactatacttcagcctgggcgacagtgagactcagtctcaaaaaaaaaaaaaaaagctatccttttgtttgaggaatgcccaaaacattgcagcccaatctatttggttatcgaaaatttctacctttgttttgaagctgaacagacttacacctactatgtgtgtgtgtttatgcatgtgtggtttttttttgttttgttttgttttgagacggagtcttgcttttctgccaggctggcatgcagtggctcagtcttggctcgctgcaacctctgactcccaggttgaagtgattctcctgcctcaacctcctgagtagctgggactacaggagtgtgccaccatgcccagctaattttttgtattttagtagagatggggtctcaccatgttggccaggatggtctggatctcctgcccttgtgatctgcccgcttcggcctcccaaagtgctgagattacaggcgtgagccaccacacccagccatgtgtgtttgtcttattggtgtgaggcactgtcctgtaatgaaccgcttgatagttttgaaatcagaatatgaaccgggcgcggtggcttacgcctgtaatcccagcactttgggaggccaaggcgggcagatcacccgaagtcaggagttcgagaccagcctgaccaacatggcgaaaccctgtttctactaaaaaaaaattcaagaaatcagaatatgagcacaggctgtataactttctgtgagacttaggtgcctcaatttgtattgttggtcttttgcacagtttttgatgagtatgaaagaggcactcaagttaaatatgagatcaatatgttagtcttttttctatacgcccatatttagcttgctgtcttattcatctccatggaaatgtagaaactcataagaacaaaagacaatttgaagtcagcttggagatttttatgggaaaaagttatttcttgggcctctgctgattgcaaaatgtggtggttctaggtatgaagcttaaagtcagggaccccatattcattcagcatctcaacttaactcttctattgggtataaatggcccggatagttgtgttcattccacaagtgaaagctagtgaccagccactggtcttctgtttctaaacctagaagatgtttgataaccagaagacaatgcagttggggcccattttttaatttaatctgagccagctttttattagttgattcccaggaagacttaggcatcaattcctttgggactatttcccaggttggatttttttctttttaaaggtctgaagatataaattagcttcaaagcccatcatgtggctagcctttaggtgagaataatgcagaattgatctgcttgtttcttttaggtcagttccttctggcacagtctatgctttgacctaatatgtggtagtggccaagagaggtttatcataacacttctcatttgatgctgtactgacgggtaggtagcaagagggagtagaagcataacttaaaatttaaaatatttagtagcctctagtatgaaacttaaacatcagttccttgtttctttcctctgagagttggtttgtagtaactggcactcaggaacatgagggaaaaaaattacatattgtgaaatggttgagaagacatgaaaatccacttgattttggtgtttccgaatttcaggcaaagaactgttttttaggttgacagggtggaattcagatacttctatgcattaactgtataatcaaaaggaaattgcttgggataggataaagaactgtggtctctttctttaaaatgtgtagatggaacagtgactatgtttttagtgctagcacgtgcatgtcagctgttacaaatatgtctcaaagaatctctctttgcatatctaggcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccaggtaaggctctgacagaggtggaaatgaggggcagaaacaaaggactcctttgatagccagtgcaagagctcacaaaagaatattgtctgccatgttgaaggttagcgtggcaggccacagcctctggtcatatctctgaccaagaaggttgtttcaagacaaagcaaaagcagtatagtttttaaccatatactgacagcatgatcttttaggtcacctatgtctacagctttccttttttacctctcctgtcataggaccccaagtgagtagtgatgtgatcactgcaataggatggcaatatcagatgaatgaatcataaaacaggaaaattcataacaggaacaatgctattttgaagtagtatgagttcatgttatggcacagtgaataaaaactgttgctttaaatattccagggcttatattcttttcctcctaaatctttaaacaaatctataaaccaatccagaattagattatttagtgttttcttagagtctatatattttaagtctgtctttttagttgtgttcaatttctcggacatagcatactagcatataatggagagaatgttgtcagtctgggagttgggagactgaatgttagtttctttccaagctatttagaagaaatatttggagtacatgcacgagcatgtaaatgaggcttataataagtgtcttggacctaacctgtctgatcctacagctatgttgcattgtatttttcttccctgtccaatacagaattttccactaaggagtaagagttaggggtctcataataacaggcaagtttgtagccacttttaattatgttttttattttgttagaagtttttaaaacattaatgctattgaaaatattttttattccactggagaagaaaaataagaaaaaggctatgacagttgtcagctagctgtcttctgaaggtttgaaaaggctaagaagcatgagtaactgttcatgatggaatactgtgccagacacgtagcccagccccaatctgccaccctctctggaccctgtgataattgcttatgtcatcagaatgtcaggaatggaatccttggtgtctctgaatgtctgccagtgttcttgttcctacagtgtaattgtagaatatccacttccatcactacttgccacctgagtagtggtacaggaaggagtttcttggaaatgagaccatgaatcttgaagccccaaaggcagaaggaactgacatttatggcttaatagctcctgtaatgttggatgtgggcctgtaggtcaatttttttttttctaccagtagttttaaaatttgtattgtgctcattattaagtctgagtataggagtgtagtgagtaaaagtaaagactcccattttatacacctctgagtctagaagtaaccgttactatcagtttggtaatacacgtgtatgcttctaaataatgtgacatcttaatgtgtactgtctaatcgttccttctttcttttttttaaaacttgaaaatgtgtcagtgacttctgtgtatatttacctcattcttgtaaattcctcaaaatgtccaaagagtaaaaatataatttaagtttatttgtagatatctgtacttttaatttttctctattaaagctcatgttgatctttaaatacttgattttctctctctttctcaaactttttttccctgactaaagatgggattttgccgttttgcctaggctggtctcaaactcctgggctcaagtaatccactgcctcagcgtcccaaagtgctggggttacagggaacatgcttgtatttctgtaagacagttttacagaagtggaattttaaaaaggaaggtcaggtgcgttatatataagctaatacttccaaattaacccctagagtgtgttattttattttacatttccccacttttagtgaaattacctacataacaacatgaaagcattcaagcatgggaattatatgctcttatttatgctgcaaatctggtatgatttaaaaagcatatgccaaagatgttttataattttgatagaaaaacattaatttctttttttttgagtcggagtttcgctcttgttgcctgggctggagtgcaatggcgtgatcttgtctcaccacaccctccgcctcccgggatcaagctattctcctgcttcagcctcctgagtagctggcattacaggcatgtgccaccatgcccggctaattttatgtttttagtagagaaggggtttctccatgttggtgaggctggtctcaaactcccgacctcaggtgatctgcccgtctcagcctcccaaagtgctgggatcacaggtgtgagccaccacgctcggtgaaaaacattaatttctaacctggcataactactgggcatttgaggctattaaaaaactttgttatgtaaatgctcaagtaggttttggcctccactctgataagtgggaaatctgaaacagcatattctagggatattattaatcagaagctcttgtgtttttctttatttttaaatttcttccattaaaaaaaagccataagtggtgggttatgcctgtaatcccagcgctttgggaggcaaaggtgggaggatcactggaagccagtagttagacaccagcctgagtctcaaagtgagactctatctctactaaaaataaaaaactgtggctcacgcctgtaatcccagcactttgggaggccaaggtggacggatcacgaggtcaggagatagagaccatcctggctaacatggtgaaaccccgtctctactaaaaaatacaaaaaattagccgggcgtggtgatgggtgcctatagtcccagctacttgggaggctgaggcaggagaatggcgtgaacccgggagaaggagcttgcagtgagccaagatcatgtcactgcactccagcctgggtgacagagcaagactccatctcaaaaaaaaaaaaaaaaaaaaaaaaaaaactggcttggcatggtggctcactcctgtaatcccagcactttatgaggctgagatgggcaaatcacttgaggttaggagtttgagaccagcctggccaacatggtgaaactccatctactaaaaaatacaaaaagtagctgggtgtggtggtcagtatctgtaatcccagctactagggaggctaaggcaagagagttgcttgaacccaggagacggaggctgtagtgagccaagattgtgccactgcactccagcctgggcgtcacagcgagactccgtctcaaaaaataaataataaaaatggctgggtgtggtggctcacccctgtaatcccagcacttcgggaggccgaggcaggcagatcacgaggtcaggggttcaagaccagcctggccaatatggtgaaaccccacctctactaataccaaaattgccagggcatggtggtgggcacctatagttccagctactccggaggccaaggcagaagaatcgcttgaacctgggaggcggtggttgcagtgagccaagatcatgccactgcactccagtctgggtgacagagcgagactcagtctcaaaaaataaaaataaatgatgctgtcacaacagcatctggaagagcaggtgaaatgaaagcatgtatgcctcatgtggttttgttttctctttttgggcttttcacccccttctctacctcagaagagggtttcagttttccagtgactcataccttagctagggcagaaaagtatttagaagggctttctatttgggtcctctctgattatcagtgcaaaatcagttacctcacatcttttctctttcattacatcaagccctactttttcttctgacctctcatttttctcagaaaagaatattctcctttgcatcaaagctgttgcataggtgggagacatgctgattcttcaaagactgaatgacatacataccttctatgcatctcttgcttttcgtacgacattataaattacaagtaacatcaacttttttgtctttgttttttgagatgtagtctggctctatcacccagggcagagtgcagtggcgctaccatggctcactgcagccttgatctcccaggctcaagcgatcctcacgcctcagtctcccaagtagctgagactataggcatgcaccacctcacttggctaattttttgactttttgtggagacggggtctcactttgttgcccacgctggtctcaaagtactgagctcaagcaatcttcccacgtcagcctcccaatgtgctgggattacaggtgtgagccaccatgcccagccaagtaacaacattttgcgccaacaaaggaagcacaggaagttttactttttttaatgagtgatgtagtcacaagtagactgcgcatgcttgtataaaagctttatggtgaggaataaccattgtctttcttggggtaaccatttgttttaaaaccagcttttgttataacctaatgaatgaatatatatatgtgtgtatatacatatatatattcattattcaatatattcattattttatatatatatatatatatatatatatatttttttttttttttttttttttttttttgagacggagtttcattcttgttgcccaggctggaatgcagtggcacaatctcagctcactgcagcctccgcctcctgggttcaagcaattctcctgcctcaggctcccaagtagctgaatttacaggcatgtgccaccatgcccagctaattttgtatttttagtagagacggtgtttctccatgttggtcaggctagtctccaactccagacctcaagtgatccgcccgcctcggcctcccaaagtgctgggattacaggcgtaagccaccgcgcccggcctatgaatatgtatatttagtaatatgtatgtgttactaaacacattgatctttggtttgttgtgttactgtgttctatcctggaattctttgtagttgaaccagaagaataccaagcctctgagagaggcttacatttcctattttgaacttgctcttcttattccagtttacttttttacttgaaatttgtattgagattcacatgcagttgtaacaaataatacatggagatcccttgtacacttcgcctagtttatcccaatggtaacatatgggaatcagtttactttctaatttgcttgttgttgcaagtgttctcataggaccaagaaaaaagaattcttgatttaaaagttttcttacaagttaaatatttagtatcacaaatgcagacaagaatttagcatccaatgaaatgatgctagaaataatagtaatagtgatgcaatatgaagcaatattataatatgagagaagtgtcaggtaatttttgtgggtggtcatgattatgattatcaggttttttagtttggattaggtttctaaatgatgtaagggagaacaactgccgtgggcaactcactctctcctactagtcagtgagagttcagaatggctttcagggaggaaatgaccctttgctaatgtaaaaacttcaatggcgcgatctcagctcaccacaacctccgcctcccaggttcaagcgattctcctgccgcagcctcccgagtagctgggattacaggcatgcaccaccatgcccagctaattttgtatttttggtagagatggagtttgtccatgttggtcaagctgatctcgaactcccaaaatcaggtgctgtactagcctcggcctccctaagtgctgggattacaggtgtgagccactgcgcacgccttggggtaaatttaagtttagttaccaaacttttttgacagcacataaatttgccaggtatttgggtgagatagattgttgggagatttatttatttgtgccaaagtgttttcctatttatttgtttggttccttagactttctctgagtggtagaagtgcaggcctggagaagcctgtatggacttttaggagcactaacagaaatccagcgtccagaggtagtcatcagtccatagactgctgtagttattaaatccatgaagaatctcgaaaagttaaccttgttaatttcagatgaaaattaaagtcagtttaaaggttccctacatgaaaactgactttaggttttacactggcaaggattgaaacagtatgtctccagttactcccaaatatgtggtatttgtaacactagggatgttaatgttggtaaaatggttctgtgtggtcattttacaaagcagtgataattagatttttctgcagggtttctcaaaaatgtgaaacaatatgtagtcactcattcagaggggagactgtaattctctaatcttccacttaatcaatttctctaaccatacatatgatactttggcctctcttttttagtgaaattatagcaagtctgcagggcatggtggctcatgcctgtaatcccagaaatttaagaggccaaggtaggaggatcgctggagcccaggagttcgagaccatcctgggcatgcaaaaaatttaagttgggatggtggcacccatttgtagtcccagctacctgggaggctgaggctagaggattgcttgagcctggagattgaagctgcaatgagctgtgatcgtgctcattgtggtgtgggagacagcacaagcctgtctttaaaaaaaaaaaaagccatatatatctatatatggcaaatcctcaaattgtgaatgttatcaatactctcatacttctgactacctttattttagaaatcacctgataatattaattagtattaccaatgtttgtattttgtgattattaaatggaggaagagtattataagtcttattatcaatatagcatatattatgagtatgttgatgtggtgggcatcttggcatccagtatgttcatatcttgttttacatataattttatatgatttattaggctacactgtatattataaaaatagacaatatatgtcagggtctggaaaatatagcatagggagaaatttgtggatagtccaataacagaatcttggccaattaaattgatattggcataccagtgggctgtgcgggagcttgaggctgcagtgagctgtgattgtgccactgcactctagtctggttgacagtgagaccctgtctcagaaaacaaaacaatagggttgggcatggtggctttgtaatcccagcactttgggaggctgaggagagcaaatcacctgaggttaggagttcaagaccatcctggccaacgtggcaaaactccattctgaaaaaataaaaaaattagccaggcatggtggcagatgcctataatcccagctatttgggaggctgagacatgagaatggcatgaatatgaaagatggaggttacagattgtgccactgctctccagccggggtgacagggagacagtctcaaaaaaaaaaaccaacaaaaacaaaacaatgggctgggagcaggtagtcaaagcaaaggaagattgaatggtaaaattcataattttaaaggaaaggatatcataacttatcagggaaatggaatttttatttacattgtgcttggaaaaacttaatacctatatatgttgttttgtttgagacacagtctccctctgtcacccaggctggagtgcagtggtgcaatctcggctcactgcaacctctgccccctgggttcaagcgattctcttgcctccgtctcctgaggcacccactaccctggctaatttttgtatttttagtagaaacagagttttgccatgttggccagagtggtctcgaattcctgacctccagtgatccacccgcctcggcctcccaaagtgctgggattacaggcatgagccaccagggctggcctacgttacctatatatgtacagaggatattaagtgctgcagtggaggaagtcttcagcaactttataatatattaactcatgtatttcattcagtaatttcctaacatgatcttggtgcagcttactgaaggagccttggctgtgatcctaagtaatcaatgtctttgcaactgtgatgctctagcagttttctggatacaagcctttggaacagcccctctagtattaatttctttcccttcatttcctctcacatcccttcagctctttgttcaggttaccctaaggttgcttatccagctcaaggacagtctccttgttagtttatttgatgtggtacagtctccaaaactgtaggacctttgaatacactgttacattgacttggtcatttgtccctaacccttcggttcctctatggtcctatcaatttttgaacttttatatcttttgagtacaagttacattattgacacaatgtatatatgatatgttaataaatactggcacttgagaatctgaaatgtaaaggtataatggaggtaaaaatctaaaacagtgacattattgaacataacttcagatgagttactaattggcatagctcttttttaagaactttttattcttatttggcgtgcaattagaaaatttcatgcttaatccttatatttctctaaactactgccataaagcctgtacacatgatttttattacagctttgagataatttgataaaatttacctattttaggtgttcggtcatttttagtatatttacagagttccaaaatttacaattgtagaataattttacaatctaatctttaggtaatcatgtaacagtctaattttagaatattatgtcactccaaaaagaaaccttatgcccattagttagaaactcccatttgcctgtcctctatctcttcactgacccctctccccacccctaaacaactatcaatccattttctatttctatagattttcctattccagataatatttcagtttcattcatattgtgacatatatcatcccttttatggtgaaataatccattgtagagccataccacatttggtttatccattcatcagttgatggctatttagagtttttacactttttggctattaagaataatgctacttgaaacatatgcattcatgtttctgtgtggacataggttctcagttttctagggtatatatctagaagtggaattgctggataatacagtaactatttagctttcaagaaactgccaaccaagctgttttccaaagtggcttcaccatttgacattcccactaacaatatataaaggttctaatttctgtaattgctttccaattcttactgtctttaattttacccattttcttgggtgtgggtttgctatctcattatgattttgatttgcatttccttaatgagcattggttttgagaatctttttatgtgattcttagctatttgcacatcttaggagaaatgtctactcaaatcctttgcacatttttaaattggattattttcacttgtaaatttttttcatatattctaaatatgagatcttataagacatcatttacaaatattttctccaattctgtaggttgtcttttcattttcttggtagtgtcctttaaagtataaaagtttttaattttgattgttagtttattcttttttcccttacacttttggtgtgatgtctaacccagggtcacaaagatttactactatgttttgtaagtgttttgtagttttagctcttagatttaggtataattcgatctgagttcattttttgtatggtgtgaggtaggggtctaaaatcatccctttagagaaaaacaaagtcatccttttacgtgttgatagtccattgttccagcaccacttattgaaaacacctctttcccatcaaattgcattctaataactcttatcaaaaatctatgaccagctgtttttgtgccatcaaaatggtgcacattgaatgtcctgaccattgctcttaagagcatcaacaatgtcaaaacaagaggcaaacatcaggttcttagaaggctgtgcccagtgttattgtccagtttctgactgatgatgaagcatggttacaatggcgaatttgaagtcatttgagatcacagagctggggaaattgttgtgaacctcacaggcaagttaaacaagtgtgatcatcctcagatttcacgtgcaactcaaagatctagaaaagtggcagaattatctgcttccacgtcatcagtttggtttcattatactgacaacttcggctggcatcacagaccatgaagaagcaagatgaaaacacacatgagggaaaaccctgggattcatgttcttggggatataatacatgcaaataaaatgcctcaacagacaaaaacaaaaccaattgataataagtgtaaaggtttatttctgttctctcagttacattccgtgggtctatatgcctctccttatgctagtactgtactgtaatgattgctgtagctttgtagtatgttttgaatttgtgaagaaaaagtcatcctactttttctttgttgagtattctggatcctttttatttccatatacattttaggttcagttttgtcaatttctgtacaaaagacagctggaattttgatagctattgcattgcacctgtagatcaatttggtggtatggccattttagcaatattaattcttacccaggcatggtggctcacgcctgtaatcccaacactttgagaggccgaggtgggcagatcacttgaagccagtagtttgagaccagcctggccaacatggtgaaatcctgtctctactaaaaatacaaaaattagccagatgtgttggcacatgcttgtaatcccaggtacttgggaggctgaggcacgagaattgcttgaatctgggaggcagatgttgtagtgagctgagattgaaccactgcactccagcctgggtgatagcgagactcagtctccaaaaaaaaaaaaaaaaaaaaaaaaatcatatttatgaacatgggctgcctttccatttatttagatgatcttttttcttttaacaatgttttgtagttttcagtgtgcaactcttgcacttttaaatgtttctctaagtctattatttttgatgctatagtgaatggaattgttttatttttggttgttgtagtgtatagaaatgcagttgatttattttgtgtattgatcttatgtaaccttgctgaactggcttattagatctagtagttttttagtaaattcttttttatttttctacatataagttcatatttgtctttatcttgccatttttataatgtaaattatttttgctgattcttatttcagtaatccacaaaagaccttaagatttagaatttaggatttttttgttttgagacagagcctcactttgttgcccaggctggagtgcagccgatcttggcccactgcaacctctgcctcctgggttcaagtgattctcgtgcctcagcctcccaagcagctggaatcacaggcatgtgctatgatgcctggctttttttttttttttttttttttttgatggagtcttgctctgtcgcccaggctggagtgcagtggcgccatctcagctcactgcaagctccatctcccaggttcatgccattctcctgcctcagcttcctgagtagctgggactacaggcgcccaccaccatgctcggctaatttttttgtattttttagtagagatggggtttcaccgtgttagccaggatggtctcgatctcttgacctcatgatccacctaccttggcctcccaaaatgctgggattacaggcgtgagccaccgtgcccggcctaattttttttgtttttttgtttgtttgttttttgttttttagagacaggatttcactgtgttggccaggctggtgtcaaattcctggcctaaagtgatcacccactttcatctcccaaagtgctaggattacaggcatgagctacaatgcctggctaattttttttttttttttttttttttttttggatttttagtggagatgggatttcaccatgttggctaggctggtctcgaactcctggcctcaagtgatctccccactttggcctcccaaagtgctgggatcacaggtatgagccactgcacccggcctagaatttaggttgatgaaaaattcttactttcatgtcctgtcaggtagatatatgactttttaaatttttcttacgattccttgtatacagcaggtaatcatagctgtgaaaaataaggataagaatccaaattgtgttgtatttaagcttcatcagaatagatggtaccttagatgcggaatataattgtcatttataagcttaaatttctagttgtgcaacatttactttggctagttttatctggattatattttgagagtactagagacctcaggcttaatttatagaagatctttaggcaagtggaatagaatatggcaggataaagctgtgaaagtaagttgtatgctgtgaaaatgaccttttatatctagtctggaaaagtctaagtaatcaaatatgtgcagaagtcccgatggtctttgagtattagacttgctatctttctgagcaaacatcatctttgagtgaatgctagttgtacaggaggaaagtaatgaaccagaagtcaagagtttgggtgattcttatagtttggcaagaggtaacttatgtgacctgttgagaaattatctaactcttagtttctgtttccacctctgcaaaaatgaagaggtatgactgaatagtggcgaatgtcctactcagaccaaaagtttagcatttcttctttctctagtctcacagttgcccataaattgacttgaaatctcacattgtgatcacatagtagcctttaaaatatatttatatcaatgtctgggtttggctctcttgagtttctaatttttaatttgttggggtagtatctcataatagagagttgtttaaaaaacaaacaaacaaaaaaacacaaaaactcccctgctgattcttacttgcaaattagttaaagaccactgctttagcaacatagaaggttgagggcagcttaatgtaaagtaatagttcaggctcccattatttttaaaatgatgaaatatgatggtgacggaaatagcaagaatgaagtaatgttacagcatttttatggtttatgaagtaatttgatatgttaagtcactgaagctgaagagcagttctgtgaaactaggaaagtgctgatcaccccccagtaagcaaatgaaggaattaagtgatttaagcttgctgtgctaattatagacagagtctgggactggaggcacatctgactccattcctattaagctatctgttaggattatgtatgatagataatctcaaagacttttagtcccttctattatgtgtttaattacccttgaaatgggacaattaccaactcagaaagatgaataaaggttaataatccaaagttgcaagtctatattactctttaggctgatgacttttaaaaaattccctatatattttcaattatgagttttaattatattaaactatatattatgtaaaatgaattgtgtaataaaaatttttaataatggccaccaattgaggtagaaaacagagtgggtgggaacagggtgaaactaattgcataatatggtaatgactcaagttgtcacataaagttgggtgtttacttggctggtgttccttggaggttatggttgcagatataccggaagacccactcatcaattttctcccttgtgttaatggtgattgatttaatttttatgtatctcttccaacgtccgccacccccattttttaaaaggcaggaaaatataacccatgggcactctagtactttgatttgctgtagtactgctgtgctattcctcatgctcctatatataggtagaacagtctattctttggtgcaatcactttggatacttctggtctctgtggctgtggttccctttagttctttgtatacgtgcctcttcatgccttagtgttcttggtagctagccggtgaatcatcagagagctgggcctcggaagtggtgctttgcggtggagttgacatgaggcttacttctgtccttctcttaagaatctcagggatgtgaggaagccctgtatgtaattctgcactaatctcactgcctttcaacttttggctttcgtggaaatgtgagacagaactgctgtggtgttttcacctgtcttaggaaagacagctctgagaagtataagaaaggttgccttgagaaattctgtttccttaagtaactaatgtttttatagtaagtattcaacattgtctattcctattggttcactgtgctttctctccctttagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccaggtcagtagcttgaaggagaataatcctcagtgcccttattacttaagttgatttgcctaaagaatgcagccaggaaagaaacagattctatgaaactcgtgtgtgtatatatgctaatggatttgcttatggaaacaaatagatctggagtcactgtggggaccaacttcagactcatccccttgtcagaaattaaggctttttccatgctgtcttaagtcttccaacttaatctgttggttattttttgaaaagtgagctactttgggaaagctctttaggacatgcagcagtatgagtgtttacatctagaataggattggctaaggggttttattcaaagtgaagtgtcaaatccttgactaaaccaataagtacttaaacatgggttttaaaggtgagtatttaaacatggccagaggcctctggataacctggaaaaaaaaaattgcctaactcctaggacactcatgagtctttaggtggtaacaccttagaatgagctctcaggtgttgggcgagcctttcatgtttattctcgtgactaatgtttgctcttggcagtttttttctaccccagtctgtgtccatcagctgttttctcacatatgctaaagaatgagatgatttttagtaagagttctttaacagtgaacattgccattccatctaagcagatagctttctttcctcaagtcacataattacctaagtcttaaattccttctttcctgccatttctaaaaaataagtaacttatagtctttttattgtactaatagcaaaaattgtcctctttcctcctggatctgaacgttgcttgagtctttggagtggagaagctgttttcggaataatagtcacattctaaaatagcccttgagcattttcagtacagcattacaagggttgtgtctgtagaggctatttggtgattagaatgggtttacgagcttggcatctgtgagtcatggaggactgtgatctcagctaaaattatctcaggggcgatgctaccagcccaaacctaccaagtggctgtcattttctcaggggcttttaaacatatgaaggacactttctgacaaaatctatggctgatagtgaaaagctgaaggaaggtggaggtcagtagatactcactcctccctaagcaattttgctgcctttggaagactttgaaaggggttaaaaagttactttttaaacttcctatctgattcattagattataaaaggaagattttactaaaagcttattgaaaaggttgcttattatggagaaaacattttgacttgtgtattttattttttccattgttttccaagtgaagaaagttcaaagaaagtttcaggttttagtactcagctgaattaatttctttttcatttgtttgactaacaaacttttacattcacactgaatagaattaggttgccttacatataaattagtaatgagattaagcaaaattgctctttattattaagagtgttggccaggcatggtggctcacgcctgtaatcccagcactttgggagactgaggtgggtggatcacttgaagtcaggagttcaagaccagcctgaccaacatgaaaccccgtctgtactaaaaatacaaaaactagccaggcgtggtggcattcgcctgtagtcgcagctactcaggaggctgaggcaggagaatcgcttcaacccaggaggctgaggttacagtgagccaagatcactgcactgcactccagcctgggtgacagaacgagactctgtttcagaaaaaaagtgtcatgcctggcattgtgggtatttattttaccacaaccatgcaatcgggattatttctatgtttatgactaaaagattcacattcttcaaaatttagataacataacttcagtctgtagcagtttttctttgtagtaacttcttagaaccattcaaggttggaatagagttgtctagtataaccagaaacataacgattgtgcaatattatttcatctcaaggcatttggccttcatttctgaagtgcttggaatttatgaactggagcagtgagttaggattacataggaacttcggttatctaattcaacgtatcaaattattctgatatcttcttcagtaatttgagctttgaggcagtcataatgcatgcactcaaaaatctttatacctaacccaagtttgtatcattcttacataaaacgtgtattttctaccgtcttgaagagtacatgccttcttgtttcgtgttctcagttgaattcactatggggttccatcttctttagatttggcaaccaagatgataaaatcagtggatgacattttttgaaaactgttcacttaagtgtaatctgtgtttacctagagtgcatgtattggctgttgctggcttaatgggaggttttaattttacttctagttattttatatataattatataataactacataactaagcaaatatccaggcaataattggttgagtaaataaaatttctttttctttcttttttttttttttttttttttttgagacggagtctcactctgtcgcccaggctggagtgcagtggcgcaatctcggctcactgcaacctccacctcctgggttcaagcaattctcctgcctcagcctctcaagtagctgggattacacgtgtgccaccaagcctggctaatattttgtatttttttggtagagatggggttttaccatgctggccaggctggccaggctggtctcgaactcctgacctcgtgacccgcctgcgttggcatcccaaagtgctaggattacaggcatgagccaccgcagctagcctatttttcttttctatctgttctgaagctgaagaaatttgatggtctctgatcaaatataatttttttatgtattttcctccaacctttaacaaaatttcttacataaaactactctaggccaggcacagtggttcacacctgtaatcccagcagtttgggaggctgaggcaggtggatcacctgaggccaggagttcaagaccagcctggccaacatggtgaaaccctgtctgtactaaaaatacaaaaagtagccacgcatggtggtgcatgcctgtagtcccagctactcaggaggctgaggcaggagaagtgcttgaacccaggaggtggaagttgcagtgagctgcgaatgcgacattgcactccagcctgggtgacagaacaagactctgtctcaaaacaaacaaacaaaaaactactctttgtgtcttccatacttcatctggggtggaggtaaagccacaaagaccaaggatttacaaactaccatgaaaatacttggtaatgaggatgtcattctggtccataaacgtgtgtatattttagatgatgtgttttcatactgaatggactctcaggtatccttacataagtcctttaacattttcatttgctctttgtactaccctttaccatcaatgccttttacattttcaatagatgctagtttttgtttctcttcaagtactgattattgtttctttggacctctcactacttgctgccctgctgagagaattagactgatattacaaatacatctaacactatctaaaattcactgcattgtttggagatactgggtattgggcttattgtacaatcccttgcaaataactagtgctcaaatatttgatatgtaatcatacttgcagtagcatgaaaacagtactaggcaagatctgaagaaattggcctcctaagttcttgtggtatggtgttttgtatgtgtgtgtaatccatgttttcaatctaatgtccatcctagaagggacttttatggtatttaaacatgttaagaaataaagatttgggttagtagatatgtatatggcttgtacctgtgtttgtttcctcctatctaaatgtcctatacttttgttggtagatctatttagctgaaatattatccatagtgacagtttgtccgtcttttgatcttgtttgttttaacttgcattttagtatgcaaccgaggatggacttatacacacaaatgaccaggccaggactctacccaaagaatgggtttgtatttaagggccccagcagttagaacatcctcagaaaagaaggtaaggctttatgatgtgcaagttaaattataaagggccaaacagagatcaagattctgaaggcatttagaaatcaactgagagaatccttcttttctttagtgtaatgtaaaatatcagatatcctggaaggaatggagactagaattaagtttgtcatctaggtacatagaatctaagcaacattaatggatgagagttgtttgttactgtggggcaagggaaaacttttccctttggacattaatttactatctctcatgtggagtacaagttgggtattcttttttttaattgaggtaaaaattacataacataaaattaaccattttaaactcatttacaactcagtggtttttagtatattcacaaaatcgtgcaactactacctcagtttagttctaaaacatttttgtcactccctgttttctctcccaatagctcctggcaactaatctgctttctgtctctatggatttggctattctggatatttcatgtaaatggaatcatacatgtgaccttttctgtgtttgtctttttaggttcacccttgtagcacgtgttaatgcttcatttgtttttatgactgaataacatttcattgcatggacatacgacattttatttatccactgatggacattttaattgtttgcactttctggctattgtgaatggtgctgatgtgagcactcatgtataattatttgaatatctgtttttaattatctttggtgtgtacccaggagtataatcactgagtcatgtagtgattcttttggattgggtatactttttcctgtttcttcttttatgttttatttttattttttttgagacagagtcttacactgttgcccgggctggagtgcaatggcataatctcagctcactgcaacctctgctcctgggttcaggtgattctcctgcctcagcctcccgagtagctgggattacaggcacctgccaccatgcctggctttttttttgtattttttagtagagacagggtttcactatgttggccaggctggtcttgaactcctgaccctgtgatctgcccacctcagccttccaaagtgctgggattataggcgtgagccaccgtgcccagcctgtttcctcttttaaaaagattgttgtaaaatatacacaacaaaacttaacaattttaaagtgtccagtagcattaagtgtacattcacattattgtgcagccaggtaccgccgtccagctccagaactttctcattttctcaaactaacattctgtatacatgaaacaagaattctccattcctccttctccccagcctatggtaactaccattctactttgtctctgtgaatgtgactattctaggtagtccttcctaagcagactgatttgtccttcggtaactggcttatttatttcacttagcattatgtgtttaagtagatttgggcatacgtttaaatgtgctttaatccaaaatgattggaaagtttttgttgcgtgtctttttccttttctagaactaaatgtagacaaaaggaaccctgataattttctttgaaaatagtcttccagattaatgttttctcctcagtccccattaatccacaatcttttcttaaaggatactggcattctttgaggcttcttgggagatgtagttgtagggatgtatttgggaattgatactggtttttcatcatttttgagttgagttttctgaagctggcatgctggcatgtcattttccaattctattaacattttcatggctgaggaccctgtgggttttaataatgtggattctaaactggaaatgaggttgccaatactttgtcatcattgagaaataagaatttgcatcttagccctttgctctgaagtgtggaaaccccagttctaagttggaagtgaagatttttttcagatctgtcattttcggtgaggtttcagtatatcttggtcctaccaaggagtgtcacgtacgaatgctttgcggtggtaatgggtgttctctagtctttgtctcagtggtgagaacacattgttctagcctgttgatatccattttggtccatattttcttttcacatgttcattgttgaacaccatgttgtttatgaatttgattaacacatagtctatatttttaaataagtatactgaataagaaatgactggaaatggaagcttttgacattacaccagaaatgtcctaaactgactacgaaccattactcaccacctctagttttctaccctgtgtttatatatttggagtcatgacagaataacagatcgggcgctgtgttcaaatccagatgtctgcatcttttcatcataataaagtcaggttaatgtgcctctctattgcaaatttttaaaaatacagatctggctaagagcagtggctcatgcctgtaatcacagcacctggggagactcaggtgggcagatcacttaagccctagaaatttgagaccagcctgggcaacatggcaaaaccctgtcactacgaaaaaaaatacagaaaattacctaggtgtggtggcatttacctccggctactccggaggctgaggtaggagggtcaattgagtccaggaggtcaaggttgcagtgagccatgattgtaccactgcagtccagcctgggtgacaaagagcaagaccctgtctcaaaacaaaaaaagcatagattactgtgtgaaatacttggcataatttatcttatttaattatcttaccaactctaggagataggattataaaagtattgggtgctcattgcaaagaatttggaacagagagacaggtataaagaagtcactaataatctcaccacccagaaacaagcataataaatacttcctttcatcctctcataccctcatgcaattttgaaccttgtttctttccccttaaccttgcattgttttatatatatttttttaccgcctccttatcaatatcaaattcattatcataaccgagtggctcatgttcttataagtacttatatccacagtttcatttgagacccaccataaccctgcaaagaggcatcatgggcccatttgacagatgaggaaatgaaacccagagaggttaggcaacttacacaagtcatacagctaatgatcaagctaacaaaaagatccaggccttctgccttcactctgaggacgcttttctgttaaccaaactgtagcatggcaaagtgcttccagtggactgcatggtggctaccgagatacgtccacatcctgatccctggaacctgtgactattaccttctatggaaaaagctgtaatgaggttcttgagaggaaaatagatcatgaattatctgggtggtccctagatacaatcactcgtgtaagaaagaggcagagggaaatcagacagagacacatacagaagaggaggcagcaatgtgacgagggaggcagagatgagagagctgttgacacagcccaggagtgttcccagctaccagcagctggaagaggcaaggacctgactgctccctggagcctccagaggatgcacagccgcactgacacagtttctcattcctggcctccagaattgttagagaatgaatacctcttattttatgccacccaatttatggtaacagcagtgacaggaaactaacagtatttttaaaaatatgttaagagggccgggtgtagtggctcacgcctgtaatcccagcactttgggaggctgaggcgggcggatcacgaggtcaggagatcgagaccgtcctggctaacacggtgaaaccccgtctctactaaaaatacaaaaaatcagctgggtgtggtggtgggcgcctgtagccccagctactcgggaggctggggcaggagaatggcatgaacccggaaggcagagcttgtagtgagccgagatcgcgccactgcactccagcctgggcaacagagcaagactccgactcaaaaaaaaatgtgtgtgtgtgtgtatgtgtgtgtgtgtgtgtgtgtgtgtgtgtgttaagagggccgggtgcggttgctcatgccggtaatcccagcattttggtaggctgaagcaggtggatcatctgaggtcaggagttcgagaccagtctggccaacgtggcgaaaccctgtctttactaaaaatagaaaaaaattagctgggtgtggtggtgtgtgcctataatcccagctactcagaaggctgaggcaggggaattgcttgaacctgggaggtggaggttgcagtgagctgagatcacgccactgcactccagcctgggcgacagagcaagactccatctcaaaaaaaaaaaaaaagaattgagcgattgatctcatggctggctataggatcaggtaaagaaagctaacacccacagcgaggtctggtaaagaagtcacactattctgtcttctcttgccttgtcccatcaacccagccaacacacgttgactatcccactgaatcagtggagatatgcttcatttaaccattcaagatgcccacaagcctttctgggaaggagattgggtgtcgggctggaagaaatgcttcctcagatcgccagaaagggtgtttttctccagttactgttacattccaagttgctttcttctttttctttttcttttttttttcttttttttgtccccatagagacaaggtctcactatgttgccccagtctggtcttgaacttctgggttcaagctgtctctctgccacagccttccaaagggctgggataccggcatgagccactgtgcctggccaagttccaagtttcgtatctgttaggtctcaaaggcaatgtcagcccccaaatttaaatctattaatgatattttggcttgtacatggtagcttatgcctgtgcatggaagattgcttgagcctggaagttcaagaatagcctgggcaatgtggtgagacctcgtctctacaaaaaattaaaagatagccaggtgtcgtcatgcatgcctgtagtccaagttactcgggaggctgaggtggaaggatggcttcagcccaggaggtcgaggttgcggtgagctgtcatcgtgccactgccctccagcctggacgacagagcgagagttaatgaatgaaaacaagttttacaaactaaagttttatattaatacataacttttgctgtcatgattataataatcatagggacatagggtttttttgtgtttttctgagatggaatctcactctgtcacccaggctggagtgtagtacttagatcagtgttatctttcccttttttgttattggactgtcagccttaagcaacagggctttgcttttttgataggtgtgttttctaggccttccataggatctgttctaaagagttcagattacataaactttctaaataatgagaaattcctactgagaaattttatgcaaaaataacacagtatttacctctgtctggacggttaccagttaattacatgaaaaaatataaaaactgtatttgatcattttgtaactttatgttgcaagttcttgtgtaagatgattaaaaagaacaaactttttataagatcttattttttccatttagataatctgagtccagaataacagtaaaaacacataggaagtacttatagtttcctgagtagctgggactacaggcgcacaccaccatgcctagctaattttttgtatttttagtagagatggggtttcaccatgttagccaggatggtctcaatctcctgacctcgtgatccgcctgcctcggcctcccaaagtgctgggattataggtgtgagccgccacgcccagccttcaagtgagccttttaccttagcctccctggtagctgagattataggtgttctccaccatgcctggctgtagaattgcagggtttttaagggattataggttcattctgtagcatatagcaccagtggtgaaatccagatatctttaaagacttctttgtatgtaatactttaatgacagtgtattacaaaataaaaacatgttttaacacagatcttatttgaaagggaaatcagatttgtaaatgtctgcagttgtaattctcaactttgtttgctatagctaaacgggaagaggaaacattatctccttctgagattgattgttttttttttttttttgctagcagttaggagtctgcagtttctttttgttgttgttgttgttgttgagacagagtcttgctctatccccaggctgaagtacagtggcgcaatctcggctcactgcaacctccacctcccgggttcaagcgattctcctgcctcagcctcccgagtagctgggactacaagcacacaccgctactcccagcttatttattatttttagtagagacagggtttcaccatgttggccaggatggtctccatctcgacctcatgatctgcccgcctcaccttcccaaagtgctgggattacaggcataaaccatcgctcctggcctcagtttcattgttacacagtcaaactccactggcattaaaaaacggttcgagaaggctaaacgtttaactttaacttttcctggcatttccacattttatcagaatatgaaggcttaattttcagcatctacaaagatgctatttcctagtataaatgtgataggaatgaagaagttggtactcactgactctaataactgacagtcccagggttgactgatgtagctggatccaagggtttgctcatccaaactcactctctgagatacccctagcaacacttggccttcactggcctggcttacgttcatcctaaaaccacaatgacctgggatatgcagggctctaactggccatgtctgggccccttgtttggctcagtggtaaaactgcctcttaggggcttgagattaggtgatggggcagttgttttcaattcaggtgctactgccaaaagaggggtaaaatagatactgatcaatagtgttgggtcattgattttcttatctgaatttagtgtcaaaggagaagcctttcagcatgtggtattttaaactgagtgccaaattgtggtcactttggaaaccacatttaaaagatgcatcctaaccaatatttccatgttttttaaatacctgatattagatttgtaccatttgtagaatctatgttattaaggcagatttaatcttgaaataaattaatcttcatgtgcttctgagacttttttttttttttttgctagcagttaggagtcttcagtttcattgttaagcagtaaaactccattagacatttcatactggccatatgaaataagactgaagtctaaaacattcctgtttttcatttacatgtcaaagtatgcataatggccatgtgtggtggctcacacatgtaatctcagcactttacagtactttagaatgccaggcaagaggaacacttgaggctgagtttgagactagcctggacgacatagggagaccccatctctaaaatatatatatatctcttttatttagcctagggccaggtgttgtgactcacacttgtaatctcagcactttgagaggtcaaggcaggaggattgctcgaggcctggagtttgagaccagactggtcaggatggtgagaatctgtctttacaaacaatttgaaaattagctggatatagtggtgtgcctgtagtcccagctgttcaggaggccgaggtggaggataccttgagcccaggaatttggggcagcaacgagctctgatctcaccactgtactccagcctgggtgacaatgcaaggcaccatctctttttgaaaaaaaaaaaaaaaaaaaaaaaaaaactgcagtgagctatgattggatcatatcactccatactccatcctgggtgatggagctagaccctgtttcaaaacaatatataatgcctactaaaagttcttattttaaggttgtatggtatataagtaaaataacatagtggaaccaatctgtattagtttaaatcctgcatctgcccattactaacttaatcattctgtgcttcagtttttccttctctaaaatggggataacaaggtaatctaaaaggttgtatgtggggatgaaataaatttatccatgatccatataaaggtgctaatcatcaactagtcacaggcatatagagcccatatgtttgctgttatgtcatgccttattgctttttttttttttttttttttttttttttgagacagagtctccctctgttgcccaggctggagtgcaatggcatgaccttggctcactgtaacctccacctcccaggttaaagcaattctcctgcctcagcctcccacatagctgggaatataggcacacaccactacgcccagctaatttttgtatttttagtagagatggggtttcaccatgttggccaggctgatctcagactcctgacttcatgtgatctgcctgcctcagcctcccaaagtgctgggattacaggcatgagccaccatgcccggctccttattgcttcttattaagtgtcttagaaattatttggaatttcttatactagaatttaactttaaaattttgtctaaattgttttgtttattttggtaatgatattgaacctctaaggaatgaatgaaatagtctctccagaaaggagctgagctgagcagggagtcggaaaccatacatgttaaactaaacacatgatactacaaagggtaggagtggtgcagaacgccaactactgtgtaaaccatggaaacttccttggctagtgctgtactcccaaagcccttgccatgtaaatgccaactatgtctgtgtgaaataataacttggaccatcttaaggctttttttccacaaagtccttgtggaatttgaaatcatttttgtggctgctgagaatgacatttagagactataacatttccttttattcacttttttttttttttttttcagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctc
